US009932598B2

(12) United States Patent
Palsson et al.

(10) Patent No.: US 9,932,598 B2
(45) Date of Patent: Apr. 3, 2018

(54) METABOLIC ENGINEERING OF MICROBIAL ORGANISMS

(71) Applicant: The Regents of the University of California, Oakland, CA (US)

(72) Inventors: Bernhard O. Palsson, La Jolla, CA (US); Adam M. Feist, San Diego, CA (US)

(73) Assignee: The Regents of the University of California, Oakland, CA (US)

( * ) Notice: Subject to any disclaimer, the term of this patent is extended or adjusted under 35 U.S.C. 154(b) by 351 days.

(21) Appl. No.: 13/957,340

(22) Filed: Aug. 1, 2013

(65) Prior Publication Data

US 2014/0038296 A1 Feb. 6, 2014

Related U.S. Application Data

(60) Provisional application No. 61/742,218, filed on Aug. 2, 2012.

(51) Int. Cl.
*C12N 15/70* (2006.01)
*C12P 7/56* (2006.01)
*C12N 9/02* (2006.01)
*C12N 9/10* (2006.01)

(52) U.S. Cl.
CPC ............ *C12N 15/70* (2013.01); *C12N 9/0008* (2013.01); *C12N 9/1029* (2013.01); *C12P 7/56* (2013.01); *C12Y 102/04001* (2013.01); *C12Y 203/01054* (2013.01)

(58) Field of Classification Search
CPC .... C12N 15/70; C12N 9/0008; C12N 9/1029; C12Y 102/04001; C12Y 203/01054; C12P 7/56
See application file for complete search history.

(56) References Cited

PUBLICATIONS

Feist, Adam Michael. (2008). Model-driven metabolic engineering of *Escherichia coli*: a systems biology approach. UC San Diego: b6635952. Retrieved from: https://escholarship.org/uc/item/55w152gs.*
Oren, A."Prokaryote diversity and taxonomy: current status and future challenges." Philos Trans R Soc Lond B Biol Sci. Apr. 29, 2004;359(1444):623-38.*
Andersen, R. "Diversity of eukaryotic algae." Biodiversity & Conservation1, 267-292 (1992).*
Guiry, Michael. "How many species of algae are there?." Journal of Phycology, 48, 1057-1063.*
Wade, William. "Uncluturable bacteria—the uncharacterized organisms that cause oral infections" J R Soc Med. Feb. 2002; 95(2): 81-83.*

Zhu et al. "Homolactate fermentation by metabolically engineered *Escherichia coli* strains." Appl Environ Microbiol. Jan. 2007;73(2):456-64.*
Wang et al. "Programming cells by multiplex genome engineering and accelerated evolution." Nature. Aug. 13, 2009;460(7257):894-8.*
Feist A. "Model-Driven Metabolic Engineering of *Escherichia coli* : A Systems Biology Approach." University of California—San Diego. Presented Nov. 2008.*
Jeffrey David Orth. "Systems biology analysis of *Escherichia coli* for discovery and metabolic engineering." Publication Date Jan. 20, 2012. Retrieved from: http://escholarship.org/uc/item/3h74m1h6.*
Feist AM, "Model-Driven Metabolic Engineering of *Escherichia coli*: A systems biology approach". Powerpoint presentation from Thesis Defense, University of California, San Diego Department of Bioengineering, dated Nov. 25, 2008, in 47 pages.
Feist AM, Zielinski DC, Orth JD, Schellenberger J, Herrgard MJ, Palsson BO. Model-driven evaluation of the production potential for growth-coupled products of *Escherichia coli*. Metab Eng. 2010,12(3): pp. 173-186.
Acharya S, Foster PL, Brooks P, Fishel R. The coordinated functions of the *E. coli* MutS and MutL proteins in mismatch repair. Mol Cell 2003,12(1): pp. 233-246.
Alper H, Jin YS, Moxley JF, Stephanopoulos G. Identifying gene targets for the metabolic engineering of lycopene biosynthesis in *Escherichia coli*. Metab Eng 2005, 7(3): pp. 155-164.
Alper H, Miyaoku K, Stephanopoulos G. Construction of lycopene-overproducing *E. coli* strains by combining systematic and combinatorial gene knockout targets. Nat Biotechnol 2005, 23(5): pp. 612-616.
Bailey JE. Toward a science of metabolic engineering. Science 1991, 252(5013): pp. 1668-1675.
Becker SA, Feist AM, Mo ML, Hannum G, Palsson BO, Herrgard MJ. Quantitative prediction of cellular metabolism with constraint-based models: The COBRA Toolbox. Nat. Protocols 2007, 2(3): pp. 727-738.
Burgard AP, Pharkya P, Maranas CD. Optknock: a bilevel programming framework for identifying gene knockout strategies for microbial strain optimization. Biotechnol Bioeng 2003, 84(6): pp. 647-657.
Chang DE, Jung HC, Rhee JS, Pan JG. Homofermentative production of D- or L-lactate in metabolically engineered *Escherichia coli* RR1. Appl Environ Microbiol 1999, 65(4): pp. 1384-1389.
Datsenko KA, Wanner BL. One-step inactivation of chromosomal genes in *Escherichia coli* K-12 using products. Proc Natl Acad Sci U S A. 2000, 97(12): pp. 6640-6645.
Dien BS, Nichols NN, Bothast RJ. Recombinant *Escherichia coli* engineered for production of L-lactic acid from hexose and pentose sugars. J Ind Microbiol Biotechnol 2001, 27(4): pp. 259-264.
Feist AM, Henry CS, Reed JL, Krummenacker M, Joyce AR, Karp PD, Broadbelt LJ, Hatzimanikatis V, Palsson BO. A genome-scale metabolic reconstruction for *Escherichia coli* K-12 MG1655 that accounts for 1260 ORFs and thermodynamic information. Mol Syst Biol 2007, 3(121). pp. 1-18.
Feist AM, Herrgard MJ, Thiele I, Reed JL, Palsson BO.. Reconstruction of biochemical networks in microbial organisms. Nat Rev Microbiol Feb. 2009, 7: pp. 129-143.
Feist AM, Palsson BO. The growing scope of applications of genome-scale metabolic reconstructions using *Escherichia coli*. Nat Biotech 2008, 26(6): pp. 659-667.

(Continued)

*Primary Examiner* — Titilayo Moloye
(74) *Attorney, Agent, or Firm* — Knobbe, Martens, Olson & Bear, LLP

(57) ABSTRACT

Microbial strains with desirable carbohydrate productions characteristics and methods of making and using the same are provided herein.

18 Claims, 5 Drawing Sheets

(56) References Cited

PUBLICATIONS

Fong SS, Burgard AP, Herring CD, Knight EM, Blattner FR, Maranas CD, Palsson BO. In silico design and adaptive evolution of *Escherichia coli* for production of lactic acid. Biotechnol Bioeng 2005, 91(5): pp. 643-648.

Fong SS, Marciniak JY, Palsson BØ. Description and Interpretation of Adaptive Evolution of *Escherichia coli* K-12 MG1655 Using a Genome-scale in silico Metabolic Model. Journal of Bacteriology 2003, 185(21): pp. 6400-6408.

Fong SS, Palsson BO. Metabolic gene-deletion strains of *Escherichia coli* evolve to computationally predicted growth phenotypes. Nat Genet 2004, 36(10): pp. 1056-1058.

Giraud A, Matic I, Tenaillon O, Clara A, Radman M, Fons M, Taddei F. Costs and benefits of high mutation rates: adaptive evolution of bacteria in the mouse gut. Science 2001, 291(5513): pp. 2606-2608.

Herring CD, Raghunathan A, Honisch C, Patel T, Applebee MK, Joyce AR, Albert TJ, Blattner FR, van den Boom D, Cantor CR and others. Comparative genome sequencing of *Escherichia coli* allows observation of bacterial evolution on a laboratory timescale. Nat Genet 2006, 38(12): pp. 1406-1412.

Hofvendahl K, Hahn-Hagerdal B. Factors affecting the fermentative lactic acid production from renewable resources1. Enzyme and Microbial Technology 2000, 26(2-4): pp. 87-107.

Ibarra RU, Edwards JS, Palsson BO. *Escherichia coli* K-12 undergoes adaptive evolution to achieve in silico predicted optimal growth. Nature2002,420(6912): pp. 186-189.

Lee KH, Park JH, Kim TY, Kim HU, Lee SY. Systems metabolic engineering of *Escherichia coli* for L-threonine production. Mol Syst Biol 2007, 3: p. 149.

Lee SJ, Lee DY, Kim TY, Kim BH, Lee J, Lee SY. Metabolic engineering of *Escherichia coli* for enhanced production of succinic acid, based on genome comparison and in silico gene knockout simulation. Appl Environ Microbiol 2005, 71(12): pp. 7880-7887.

Lee SY, Kim JM, Song H, Lee JW, Kim TY, Jang YS. From genome sequence to integrated bioprocess for succinic acid production by Mannheimia succiniciproducens. Appl Microbiol Biotechnol 2008, 79(1): pp. 11-22.

Lee SY, Papoutsakis ET., eds. Metabolic Engineering: Marcel Dekker, Inc. New York. 1999.

Neidhardt FC, editor. *Escherichia coli* and *Salmonella*: cellular and molecular biology. 2nd ed. Washington, D.C.: ASM Press. 1996.

Oh YK, Palsson BO, Park SM, Schilling CH, Mahadevan R.. Genome-scale reconstruction of metabolic network in bacillus subtilis based on highthroughput phenotyping and gene essentiality data. J Biol Chem. 2007, 82(9): pp. 28791-28799.

Park JH, Lee KH, Kim TY, Lee SY, Metabolic engineering of *Escherichia coli* for the production of L-valine based on transcriptome analysis and in silico gene knockout simulation. Proc Natl Acad Sci U S A 2007,104(19): pp. 7797-7802.

Park JH, Lee SY, Kim TY, Kim HU. Application of systems biology for bioprocess development. Trends Biotechnol 2008. 26(8): pp. 404-412.

Patil KR, Rocha I, Forster J, Neilsen J. Evolutionary programming as a platform for in silico metabolic engineering. BMC Bioinformatics 2005, 6: p. 308.

Price ND, Reed JL, Palsson BO. Genome-scale models of microbial cells: evaluating the consequences of constraints. Nat Rev Microbiol 2004, 2(11), pp. 886-897.

Reed JL, Patel TR, Chen KH, Joyce AR, Applebee MK, Herring CD, Bui OT, Knight EM, Fong SS, Palsson BO. Systems approach to refining genome annotation. Proc Natl Acad Sci U S A 2006, 103(46): pp. 17480-17484.

Schlensog V, Bock A. The *Escherichia coli* fdv gene probably encodes mutS and is located at minute 58.8 adjacent to the hyc-hyp gene cluster. J Bacteriol 1991, 173(23): pp. 7414-7415.

Shaver AC, Dombrowski PG, Sweeney JY, Treis T, Zappala RM, Sniegowski PD. Fitness evolution and the rise of mutator alleles in experimental *Escherichia coli* populations. Genetics 2002,162(2): pp. 557-566.

Stephanopoulos G, Nielsen J, Aristidou A. 1998. Metabolic Engineering. San Diego: Academic Press.

Varma A, Palsson BO. Stoichiometric flux balance models quantitatively predict growth and metabolic by-product secretion in wild-type *Escherichia coli* W3110. Applied and Environmental Microbiology 1994. 60(10): pp. 3724-3731.

Wang Q, Chen X, Yang Y, Zhao X. Genome-scale in silico aided metabolic analysis and flux comparisons of *Escherichia coli* to improve succinate production. Appl Microbiol Biotechnol 2006. V73(4): pp. 887-894.

Zhou S, Causey TB, Hasona A, Shanmugam KT, Ingram LO. Production of Optically Pure D-Lactic Acid in Mineral Salts Medium by Metabolically Engineered *Escherichia coli* W3110. Appl. Environ. Microbiol. 2003. 69(1): pp. 399-407.

Zhu Y, Eiteman MA, DeWitt K, Altman E. Homolactate fermentation by metabolically engineered *Escherichia coli* strains. Appl Environ Microbiol 2007. 73(2): pp. 456-464.

NCBI Gene search results for "pFLA" [Gene Name] entries with a creation date on or before Aug. 1, 2013, printed from the world wide web at https://www.ncbi.nlm.gov/gene on Mar. 11, 2016, in 10 pages.

NCBI Gene search results for "pFLB" [Gene Name] entries with a creation date on or before Aug. 1, 2013, printed from the world wide web at https://www.ncbi.nlm.gov/gene on Mar. 11, 2016, in 3 pages.

NCBI Gene search results for "pFLC" [Gene Name] entries with a creation date on or before Aug. 1, 2013, printed from the world wide web at https://www.ncbi.nlm.gov/gene on Mar. 11, 2016, in 2 pages.

NCBI Gene search results for "pFLD" [Gene Name] entries with a creation date on or before Aug. 1, 2013, printed from the world wide web at https://www.ncbi.nlm.gov/gene on Mar. 11, 2016, in 2 pages.

NCBI Protein search results for "pyruvate dehydrogenase" [Protein Name] with a publication date on or before Aug. 1, 2013, search results downloaded from the world wide web at https://www.ncbi.nlm.gov/protein on Mar. 16, 2016, also included is a screen shot of the search results page, summarizing the taxonomic groups included in the search, in 2467 pages.

NCBI Protein search results for "pyruvate formate lyase" [Protein Name] with a publication date on or before Aug. 1, 2013, search results downloaded from the world wide web at https://www.ncbi.nlm.gov/protein on Mar. 16, 2016, also included is a screen shot of the search results page, summarizing the taxonomic groups included in the search, in 1223 pages.

UniProtKB-POA9N4 (PFLA_ECOLI), Integrated Into UniProtKB/Swiss-Prot Jul. 19, 2006, and printed from the world wide web at www.uniprot.org/uniprot/P0A9N4 on May 2, 2017, in 7 pages. It is noted that this item refers to a web page, and may have been available in some form prior to the date on which it was printed.

UniProtKB-P09373 (PFLB_ECOLI), integrated into UniProtKB/Swiss-Prot Jul. 1, 1989, and printed from the world wide web at www.uniprot.org/uniprot/P09373 on May 2, 2017, in 9 pages. It is noted that this item refers to a web page, and may have been available in some form prior to the date on which it was printed.

UniProtKB-P32675 (PFLC_ECOLI), integrated into UniProtKB/Swiss-Prot Oct. 1, 1993, and printed from the world wide web at www.uniprot.org/uniprot/P32675 on May 2, 2017, in 7 pages. It is noted that this item refers to a web page, and may have been available in some form prior to the date on which it was printed.

UniProtKB-P32674 (PFLD_ECOLI), integrated into UniProtKB/Swiss-Prot Oct. 1, 1993, and printed from the world wide web at www.uniprot.org/uniprot/P32674 on May 2, 2017, in 7 pages. It is noted that this item refers to a web page, and may have been available in some form prior to the date on which it was printed.

UniProtKB-POAC23 (FOCA_ECOLI), integrated into UniProtKB/Swiss-Prot Nov. 8, 2005, and printed from the world wide web at www.uniprot.org/uniprot/P0AC23 on May 2, 2017, in 7 pages. It is noted that this item refers to a web page, and may have been available in some form prior to the date on which it was printed.

\* cited by examiner

METABOLIC ENGINEERING OF MICROBIAL ORGANISMS

RELATED APPLICATIONS

The present application claims the benefit of U.S. Provisional Application No. 61/742,218, filed on Aug. 2, 2012, which is hereby incorporated by reference in its entirety. The present application is related to U.S. Provisional Application No. 61/401,017, filed Aug. 4, 2010, and U.S. Provisional Application No. 61/273,426, filed Aug. 3, 2009, each of which is hereby incorporated by reference in its entirety.

SEQUENCE LISTING AND TABLES IN ELECTRONIC FORMAT

The present application is being filed along with a Sequence Listing in electronic format. The Sequence Listing is provided as a file entitled UCSD033001ASEQUENCE.txt, last saved Aug. 1, 2013, created on Jul. 31, 2013, which is 53,033,897 bytes in size. The information in the electronic format of the Sequence Listing is incorporated herein by reference in its entirety.

BACKGROUND

Through the process of metabolic engineering, microbial organisms can be engineered for the production of various desirable compounds. Such engineered microbial strains and their products can be useful. For example, some microbial strains can produce chemicals from renewable feedstocks rather than from nonrenewable petroleum. Metabolic engineering has been practiced for many years, and the traditional approaches have included strategies such as random mutagenesis with selection for an over-producer or over-expression of genes either directly responsible for secondary metabolite production or genes indirectly involved in increasing metabolite production. Provided herein are engineered microbial strains with useful carbohydrate production characteristics. In some embodiments, the engineered microbial strains are designed using a genome-scale metabolic model so as to systematically select a strain with a desired phenotype.

FIELD

The field relates generally to genetically engineered microbial organisms. In some embodiments, microbial organisms genetically engineered for high-yield production of carbohydrates are provided.

SUMMARY

In one embodiment, a genetically engineered microbial organism comprising a genetic modification which substantially reduces pyruvate format lyase (PFL) activity and a genetic modification which substantially reduces pyruvate dehydrogenase (PDH) activity is provided. In some aspects of this embodiment, the production of carbohydrates comprises producing D-lactate from a glucose precursor. In some aspects of this embodiment, the genetic modification which substantially reduces PFL activity reduces PFL activity by at least about 70%. In some aspects of this embodiment, the genetic modification which substantially reduces PDH activity reduces PDH activity by at least about 70%. In some aspects of this embodiment, the genetic modification which substantially reduces PFL activity reduces PFL activity by at least about 90%, and wherein the genetic modification which substantially reduces PDH activity reduces PDH activity by at least about 90%. In some aspects of this embodiment, the genetic modification which substantially reduces PFL activity eliminates PFL activity, and wherein the genetic modification which substantially reduces PDH activity eliminates PDH activity. In some aspects of this embodiment, the microbial organism has undergone adaptive evolution. In some aspects of this embodiment, the genetically engineered microbial organism further comprises a genetic modification that increases that increases the mutation rate of the microbial organism at least about 2-fold per generation. In some aspects of this embodiment, the genetic modification that increases the mutation rate comprises a loss-of-function mutation in the mutS gene. In some aspects of this embodiment, the genetic modification which substantially reduces PFL activity is selected from the group consisting of: a hypomorphic mutation in each of pflABfocA and pflDC, a phenotypic null mutation in each of pflABfocA and pflDC, a deletion of each of pflABfocA and pflDC, a hypomorphic mutation in pflABfocA and a deletion of pflDC, a deletion of pflABfocA and a hypomorphic mutation in pflDC, a hypomorphic mutation in pflABfocA and a phenotypic null mutation in pflDC, a null mutation in pflABfocA and a hypomorphic mutation in pflDC, a deletion of in pflABfocA and a null mutation in pflDC, and a phenotypic null mutation in pflABfocA and a deletion of pflDC. In some aspects of this embodiment, the genetic modification which substantially reduces PDH activity is selected from the group consisting of a hypomorphic mutation in aceEF, a null mutation in aceEF, and a deletion of aceEF. In some aspects of this embodiment, the genetic modification which substantially reduces PFL activity comprises a deletion of each of pflABfocA and pflDC, and wherein the genetic modification eliminating PDH activity comprises a deletion of aceEF. In some aspects of this embodiment, the organism comprises a genotype of: pflABfocA pflDC aceEF xylFGH rbsACB alsBAC mutS. In some aspects of this embodiment, the organism is of one of the BOP384eG1 strain or BOP384eG2 strain. In some aspects of this embodiment, the genetically engineered microbial further comprises deletion of each of a native xylGFH, rbsACB, and alsBAC operon. In some aspects of this embodiment, the genetically engineered microbial organism further comprises at least one mutation selected from the group consisting of: 1022011 C→T, 111897 G→A, 1135244 A→G, 1137595 A→G, 1163111 A→G, 1247873 G→A, 1260197 C→T, 1274794 T→C, 1386732 A→G, 1435247 Δ1 bp, 1440978 G→A, 1580390 A→, 1604028 T→C, 1610530+C, 1679479 T→C, 1682336 A→G, 1729483 G→A, 1760136 G→A, 1866695 G→A, 1929016 G→A, 1950262 G→A, 1976527 Δ776 bp, 2071288 G→A, 2085304+G, 2098010 T→C, 2257220 A→G, 2358479+C, 2405257 G→C, 2534334 Δ1::IS186 (−)+6 bp::Δ1, 2620968 Δ1 bp, 2662540 T→C, 2732557+C, 2740321 T→C, 2763809+C, 2767188 G→A, 2782127 A→G, 2809146+A, 2824039 T→C, 2826646 G→A, 2844070 G→A, 2926442+T, 2927497 G→A, 2932138 TA, 2965591 T→C, 2975919 T→C, 3114125 C→T, 3176882 G→A, 3218853 T→C, 3246033 G→A, 3268091 C→T, 3268123 CA, 3268165 C→T, 3279141 C→T, 3302829 Δ1 bp, 3315496 A→G, 3335733 C→T, 34111+T, 3429378 T→C, 345189 A→G, 3506796 T→C, 3526004 T→C, 3548297 T→C, 379237 Δ1 bp, 379237 Δ2 bp, 386281 C→T, 3955730 G→A, 3957957 C→T, 3978813 C→A, 3982057 C→T, 3983344 C→T, 3990407 Δ8 bp, 407943 A→G, 4105271 A→G, 4153541 A→G, 42111 C→A, 4234068 T→G, 4294403+CG, 4306572 3434 bp→82 bp, 4444833 A→G, 4503718 G→A, 454725 C→T, 4604230+G, 4604346 Δ1 bp, 507894 T→C, 533362 A→G, 547694 A→G, 547831+G, 558493 G→T, 560913+G, 619171 A→G, 653396 T→C, 696062 G→A, 700027 C→T, 700286+C, 700599+C, 700679+G, 751964 C→T, 760544 C→T, 844446 C→T, 852434+A, 922473+G, 961467 C→T, and 963462 A→G, with reference to SEQ ID NO: 1. In some aspects of this embodiment, the microbial organism comprises the mutations annotated in any one of SEQ ID NOs: 2-9. In some aspects of this embodiment, the genetically engineered microbial organism has a steady-state glucose uptake rate of at least about 30 mmol per gDW per hour under standard conditions in 1 g per liter yeast extract medium, for example at least about 30 mm per gDW per hour, 35, 40, 45, 50, 55, 60, 65, 70, 75, 80, 85, 90, 95, or 100 mm per gDW per hour. In some aspects of this embodiment, the microbial organism is a recombinant E. coli.

Another embodiment includes a method of producing a genetically engineered microbial organism that has a steady-state glucose uptake rate of at least about 30 mmol per gDW per hour in a medium comprising 1 g per liter yeast extract, and the method includes performing at least one cycle of adaptive evolution on a culture of a microbial organism as described herein. In some aspects of this embodiment, the adaptive evolution comprises at least one of steady-state evolution or serial passage exponential evolution. In some aspects of this embodiment, the adaptive evolution comprises at least 14 days of adaptive evolution. In some aspects of this embodiment, the adaptive evolution comprises at least 16 days of adaptive evolution. In some aspects of this embodiment, the steady-state glucose uptake is at least about 40 mmol per gDW per hour under standard conditions in 1 g per liter yeast extract medium.

Another embodiment includes a genetically engineered microbial organism comprising a genetic modification which reduces pyruvate format lyase (PFL) activity and a genetic modification which reduces pyruvate deghydrogenase (PDH) activity, in which the genetically engineered microbial organism has a steady-state glucose uptake rate of at least about 30 mmol per gDW per hour under standard conditions in 1 g per liter yeast extract medium.

DETAILED DESCRIPTION

Figure 1:
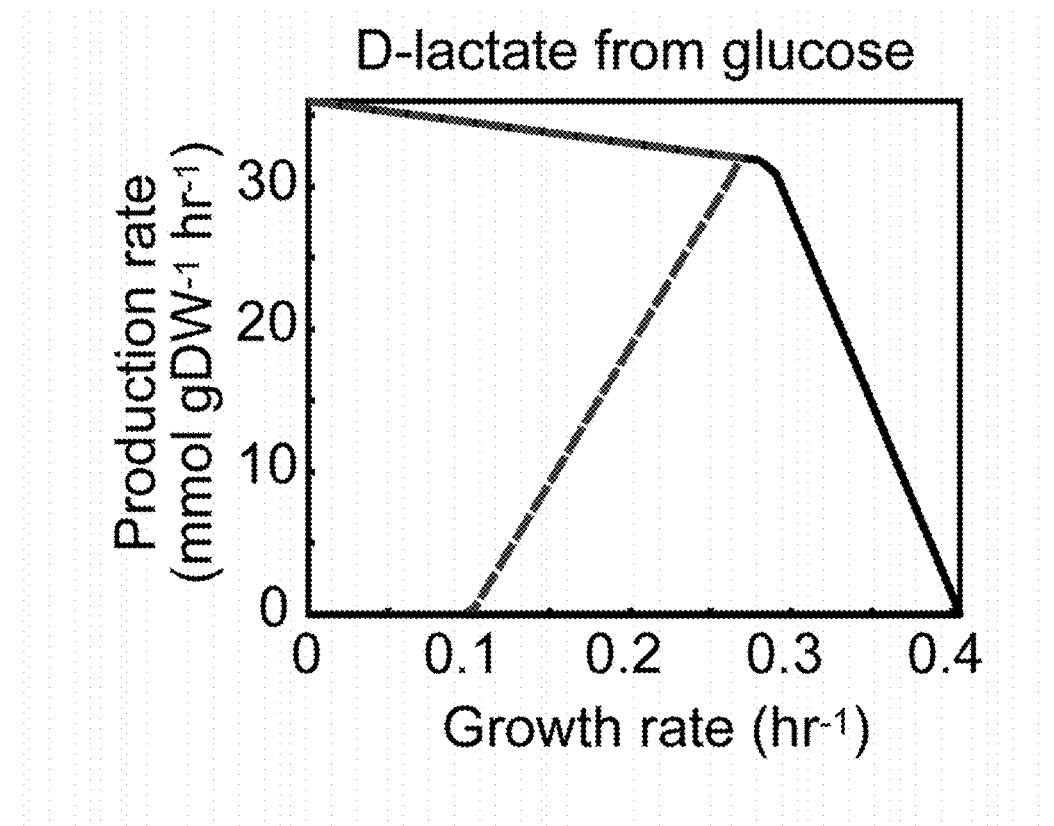
FIG. 1 is a graph illustrating the predicted production envelopes for strains constructed according to some embodiments herein. This production envelope was determined to be a superior design out of a pool of designs that was computationally generated. The glucose uptake rate is 18 mmol gDW$^{-1}$ hr$^{-1}$ (a typical wild-type anaerobic uptake rate) and minimal medium conditions were used

According to some embodiments herein, microbial organisms are provided. The microbial organism can be configured to produce a carbohydrate from a precursor. In some embodiments, the microbial organism includes mutations eliminating format lyase (PFL) activity and pyruvate dehydrogenase (PDH) activity. In some embodiments, the microbial organism is E. coli. In some embodiments, the microbial organism further undergoes adaptive evolution, and organisms with desired carbohydrate production characteristics are selected. To expedite adaptive evolution, the microbial organism can comprise at least one genetic modification that increases the mutation rate. In some embodiments, the mutation is a mutS mutation. In some embodiments, the microbial organism has at least a pflABfocA pflDC aceEF genotype. Optionally, the microbial organism can include additional mutations. In some embodiments the microbial organisms has a pflABfocA pflDC aceEF xylFGH rbsACB alsBAC mutS genotype.

Metabolic engineering is a growing field for which new methods are being developed to generate microbial products rapidly and efficiently. According to some embodiments, two approaches that can aid this process are analysis of growth-coupled production using constraint-based modeling, and adaptive evolution for strain optimization. In some embodiments, the constraint-based modeling may comprise the modeling described in U.S. Provisional Application No. 61/742,218, filed on Aug. 2, 2012, U.S. Provisional Application No. 61/401,017, filed Aug. 4, 2010, now expired, or U.S. Provisional Application No. 61/273,426, filed Aug. 3, 2009, the disclosure of each of which are hereby incorporated by reference in their entireties. In some embodiments the two approaches are combined, for example by selecting a strain identified from a model-driven analysis of the production of native microbial metabolites (for example, *Escherichia coli* metabolites, see Feist et al. 2010), evolving it using adaptive evolution, and characterizing its production capabilities. As such, in some embodiments, an engineered microbial strain is provided. In some embodiments adaptive evolutions results in a substantial increase in growth rate and/or substrate consumption rate for this strain. In some embodiments, the production phenotype of this strain is similar to the computationally predicted phenotype. In some embodiments, the production phenotype of this strain is similar to the computationally predicted phenotype, for example exhibiting substantial increases in growth rate and/or substrate consumption rate, and/or product production rate.

Carbohydrates

Lactic acid (and its corresponding lactate ions, for example D-Lactate) is an industrially relevant chemical with many practical uses. In some embodiments, lactic acid or a derivative thereof is useful in the food and beverage industry as an acidulant or as a preservative, or in polylactic acid (PLA), a biodegradable plastic.

A variety of carbohydrates can be produced by microbial organisms from a variety of precursors (also referred to herein as "substrates") under a variety of conditions. In some embodiments, at least one of D-Lactate, Glycerol, L-Alanine, L-Serine, Pyruvate, Fumarate, L-Malate, Succinate, 2-Oxoglutarate, or L-Glutamate is produced by a microbial organism. In some embodiments, the carbohydrate is produced under aerobic conditions. In some embodiments, the carbohydrate is produced under anaerobic conductions. In some embodiments, the carbohydrate is produced from a precursor, for example glucose or xylose. In some embodiments, D-lactate is produced from a glucose precursor.

Genetic Modifications

A variety of genetic modifications, for example mutations, can be provided according to some embodiments herein. A genetic locus in a microbial organism can produce one or more gene products. In some embodiments, the gene product is a nucleic acid, for example a ribosomal RNA. In some embodiments, the gene product is a polypeptide.

A genetic modification affecting one or more genetic loci can cause a loss-of-function in the gene product, a gain-of-function in the gene product, and/or can cause the gene product to adopt a new function. In some embodiments, a loss-of-function mutation is provided that reduces, but does not eliminate activity of the gene product (this class of mutation can also be referred to herein a "hypomorphic" mutation or "partial loss-of-function" mutation). In some embodiments, a loss-of-function mutation substantially reduces gene product activity. As used herein, "substantially reduces" gene product activity and variations of this root term refer to at least a 50% reduction in gene product activity compared to wild-type, for example, a 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.9%, 99.99%, or 99.999% reduction. In some embodiments, a loss-of-function mutation eliminates gene product activity (this class of mutation can also be referred to herein as a "null" mutation). In some embodiments, a null mutation eliminates at least the gene-product-encoding sequence of a genetic locus. In some embodiments a null mutation eliminates the entire genetic locus. While a deletion of a genetic locus is a type of null mutation, null mutations can also encompass other sorts of genetic modifications. In some embodiments, a null mutation does not eliminate gene-product-encoding sequence, but prevents expression of the gene product (for example, by eliminating a promoter, a translation start sequence, or introducing an early stop codon). In some embodiments, a null mutation does not eliminate gene-product-encoding sequence or expression of a gene product, but eliminates or substantially eliminates activity of the gene product (for example, by mutating one or more catalytic residues from a protein). This latter class of null mutation may also be referred to herein as a "phenotypic null," or variations of this root term. In some embodiments, a loss-of-function mutation is a dominant negative mutation.

In addition to mutation of a genetic locus, other genetic modifications can also reduce or eliminate gene activity. By way of non-limiting example, antisense oligonucleotides can reduce or eliminate activity of the target gene. In some embodiments, a genetic modification for reducing gene expression comprises at least one antisense oligonucleotide. In some embodiments, an antisense oligonucleotide comprises an RNA complementary to at least a portion of a transcript of a target gene. In some embodiments, a microbial cell is genetically modified to express an antisense RNA directed to at least one transcript of the target gene. Additional exemplary genetic modifications that can be used to reduce gene activity in accordance with some embodiments herein include ribozymes, transcriptional repressors, inducible promoters, proteases directed to polypeptide encoded by a target gene, and the like.

In some embodiments, a mutation or genetic modification eliminates the activity of two or more gene products. In some embodiments, a mutation deletes an operon. In some embodiments, a mutation eliminates activity of one gene, and as a result, also eliminates activity of a second gene (for example, if the products of gene A and gene B function as a dimer, the elimination of either of gene A activity or gene B activity can also eliminate activity of the other gene).

A variety of techniques for making mutations are known to the skilled artisan. In some embodiments, a desired mutation is introduced via homologous recombination. A variety of vectors can be used for homologous mutation, for example phage or viral vectors, plasmid vectors, artificial chromosomes, and the like. In some embodiments, the vector is a pKD46, pKD13, or pCP20 plasmid, or variant thereof. In some embodiments, homologous sequences on a vector flank a genetic locus that can be used to identify homologous recombinants, for example an antibiotic resistance marker (for example, but not limited to kanamycin, chloramphenicol, or ampicillin resistance) or metabolic enzyme that permits an auxotroph to survive in a particular minimal medium. In some embodiments, mutations are introduced into at least a genome are random, and mutant microbial organisms having the desired mutations are selected.

In some embodiments, a host genome or portion thereof is synthesized, and introduced into a microbial organism. In some embodiments an entire host genome having the desired genetic features is synthesized and inserted into a microbial cell (see, e.g. Gibson et al., Science 2: 329, pp. 52-56, hereby incorporated by reference in its entirety).

Metabolic Engineering

In some embodiments, a systems biology based approach to metabolic engineering comprises growth-coupled design, in which the production of a metabolite by a microbial strain increases as growth rate increases (Burgard et al. 2003). Some traditional strain designs have relied on genetic manipulations that alter the metabolism in a way that typically redirects metabolic flux from producing biomass to producing a specific desired product. Without being limited by any particular theory, such strains can be highly unstable, and if left unsupported, mutations that increase growth rate at the cost of production can occur, and the strain can lose productivity over time. Furthermore, it is unusual for the increased secretion of a metabolic by-product alone to simultaneously increase growth rate. However, according to some embodiments, genome-scale metabolic models and constraint-based analysis methods can predict genetic manipulations that couple production objectives to a selection pressure (i.e., growth rate). Laboratory adaptive evolution can then be used as a tool to optimize in vivo strain designs.

OptKnock (Burgard et al. 2003) and OptGene (Patil et al. 2005) are two in silico algorithms, either or both of which can be used for designing growth-coupled strains according to some embodiments herein. Several OptKnock designs for the production of lactic acid have been constructed and adaptively evolved in vivo, and it was found that the experimental results closely agreed with the computational predictions (Fong et al. 2005). An in silico screen of the growth-coupled design potential of E. coli was conducted utilizing the genome-scale metabolic reconstruction and model iAF1260 and the aforementioned design algorithms (Feist et al. 2010). As such, in some embodiments, an iAF1260 model of E. coli is provided. According to some embodiments herein, a growth-coupled design for producing a carbohydrate is identified. In some embodiments, the carbohydrate is D-lactate. This design may be based on computationally predicted properties such as high predicted product yield, ability to produce and secrete only one compound (homofermentation), and use of well characterized metabolic pathways to produce the targeted product. According to some embodiments herein, computationally driven growth-coupled strain design processes are followed by construction of a strain in vivo, optimization of this strain through the adaptive evolution process, and characterization of its production phenotype.

Processes developed in accordance with some embodiments herein can result in generation of a computationally-predicted production strain design. In some embodiments, a metabolic reconstruction of a microbial organism is provided. By way of non-limiting example, organisms for which metabolic reconstructions are available are listed in Feist et al. 2008a (hereby incorporated by reference in its entirety), for example Bacillus subtilis (described in Oh et al. 2007, hereby incorporated by reference in its entirety). In some embodiments, a strain design is based on a metabolic reconstruction of E. coli. In some emboidments, a strain design is based on a metabolic reconstruction of B. subtilis.

In some embodiments, a compound, precursor, and/or production strain design is selected from the designs identified from the screen of native compounds used in Feist et al. 2010. The methods described herein can be readily applied to generate further strains of E. coli or other microbial organisms. In some embodiments, a previously-described strain design is used as a starting point for a strain design according to embodiments herein. For example, the analyzeGCdesign algorithm can apply a penalty for knockouts and can be applied to reduce the total number of genetic loci mutated in a strain design. As such, in some embodiments, the analyzeGCdesign algorithm is applied to an existing strain design. In some embodiments, the analyzeGCdesign algorithm has a knockout penalty of 90%. In some embodiments, the analyzeGCdesign algorithm is used to "streamline" a particular strain design so as to minimize the number of mutations for arriving at a desired characteristic.

Adaptive Evolution

In some embodiments, the microbial strain undergoes adaptive evolution. As used herein, adaptive evolution refers to obtaining one or more organisms with one or more desired characteristics through selection for the desired characteristics. It is contemplated that unless explicitly stated otherwise herein, "selection for a desired characteristic" and variations of this root phrase encompasses both positive selection for a desired characteristic and selection against an undesired characteristic. In some embodiments, the selected characteristic comprises at least one of growth rate, consumption of substrate, production rate of carbohydrate, or production efficiency of carbohydrate. In some embodiments, direct selection for the desired characteristic is performed. In some embodiments, at least one desired characteristic is coupled to at least one other characteristic, and selection is performed for the other characteristic. In some embodiments, the other characteristic is also a desired characteristic. In some embodiments, the other characteristic is a neutral characteristic (for example a marker, or a reporter molecule).

It is contemplated herein the coupling of microbial growth and target molecule production can facilitate adaptive evolution. In some embodiments, production of target molecule (for example carbohydrate) by a strain is growth-coupled to biomass production. Without being limited by any particular theory, the strain can be required to produce target molecule in order to produce biomass, so that achievement of faster growth can require secretion of the target molecule. As such, selection for faster growth can also select for increased secretion of target molecule.

Serial passage selection (also referred to as "serial passage exponential" or "SPE" selection) can result in optimization of the strain for target production as well as growth rate. In some embodiments, adaptive evolution comprises serial passage selection. In some embodiments, growth is coupled to target product secretion, and selection is performed for growth. The selection can be performed by serial passage selection. Protocols for serial passage are described in Fong, et al. 2005. Biotechnol Bioeng 91(5):643-8; Ibarra et al., Nature 420:186-9; Fong et al. 2003. Journal of Bacteriology 185(21):6400-8; Herring et al., 2006. Nat Genet. 38(12):1406-1412; and Fong and Palsson, 2004. Nat Genet. 36(10):1056-58, each of which is hereby incorporated by reference in its entirety. Serial passage selection can comprise passaging cells so that the cells remain in exponential growth phase, and never (or almost never) reach stationary phase. By way of non-limiting example, cells can be transferred when they reach a certain optical density that is characteristic of the cells being in exponential growth phase. In some embodiments, serial passage selection can comprise sufficiently large transfer volumes so as to reduce the chance of fixation of hitchhiker mutations. In some embodiments, serial passage selection is performed in batch cultures. In some embodiments, serial passage selection is performed to select for microbial organisms with increased carbohydrate production. In some embodiments, serial passage selection is performed to select for microbial organisms with increased D-lactate production. In some embodiments, at least 2 rounds of serial passage selection are performed, for example 2, 3, 4, 5, 6, 7, 8, 9, 10, 11, 12, 13, 14, 15, 16, 17, 18, 19, 20, 30, 40, 50, 60, 70, 80, 90, 100, 150, 200, 250, 300, 350, 400, 450, 500, 600, 700, 800, 900, or 1000 rounds of serial passage selection, including ranges between any two of the listed values.

In some embodiments, adaptive evolution includes steady state evolution. Steady state evolution can comprise gradually increasing the strength of a selective pressure in order to select for at least one desired characteristic. In some embodiments steady state evolution is provided to alleviate auxotropy for one or more metabolites. In some embodiments, concentrations of metabolite are gradually decreased in continuous culture. In some embodiments, the continuous culture is performed for at least 1 day, for example 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 90 or 100 days, including ranges between any two of the listed values.

Without being limited by any particular theory, in some circumstances, adaptive evolution can be accelerated by increasing the mutation rate. As such, in some embodiments a microbial stain is engineered to have an increased mutation rate. In some embodiments, the microbial strain comprises a mutation that yields an increased mutation rate. By way of non-limiting example, the microbial strain can comprise the mutS mutation, which has been associated with increased mutation rate. In some embodiments, the microbial strain comprises a mutation (or combination of mutations) that increase the mutation rate by at least 1.2×, for example about 1.2×, 1.5×, 2×, 3×, 4×, 5×, 6×, 7×, 8×, 9×, 10×, 20×, 30×, 40×, 50×, 60×, 70×, 80×, 90×, 100×, 1000×, or 10000× compared to a reference strain lacking the mutation (or mutations) that increase the mutation rate. In some embodiments, after a strain with one or more desired characteristics is obtained through adaptive evolution, one or more mutations that increase the mutation rate are removed. In some embodiments, the mutations are replaced with wild-type sequence or functionally wild-type sequence. In some embodiments, the mutations are reverted.

Microbial Organisms

Microbial organisms and strains thereof are provided according to some embodiments herein. As used herein, "microbial organism," "microorganism," and the like refers to single cell prokaryotic, eukaryotic, and archaea. Exemplary microbial organisms include, but are not limited to, *Escherichia coli, Bacillus* species, *Pseudomonas* species, *Salmonella* species, *Rhodococcus* species, *Lactobacillus* species, *Enterococcus* species, *Alcaligenes* species, *Klebsiella* species, *Paenibacillus* species, *Arthrobacter* species, *Corynebacterium* species, *Brevibacterium* species, *Saccharomyces* species, *Pichia* species, *Candida* species, *Hansenula* species, *Cyanobacteria* species, *Bacillus subtilis, Bacillus licheniformis, Alcaligenes eutrophus, Paenibacillus macerans, Rhodococcus erythropolis, Pseudomonas putida, Lactobacillus plantarum, Enterococcus faecium, Enterococcus gallinarium*, and *Enterococcus faecalis*. In some embodiments, the microbial organism is a *Bacillus* species, for example *B. subtilis*. In some embodiments, the microbial organism is *E. coli*.

In some embodiments, a genetically engineered microbial organism comprising a genetic modification which substantially reduces pyruvate format lyase (PFL) activity and a genetic modification which substantially reduces pyruvate dehydrogenase (PDH) activity is provided. Without being limited by any particular theory, in some embodiments, removal of only two metabolic reactions can provide higher carbohydrate uptake than removal of three or more metabolic reactions. In some embodiments, the strain comprises a pflABfocA pflDC aceEF genotype or a genotype conferring a phenotype corresponding to that resulting from a pflABfocA pflDC aceEF genotype. According to some embodiments herein, a pflABfocA pflDC aceEF strain comprises one or more additional genetic modifications. In some embodiments, the strain comprises one or more antibiotic resistance markers such as kanR (also notated herein as "kan+"). In some embodiments, the strain comprises mutations in additional genetic loci, for example the operons that permit growth on xylose (for example, by knockouts of one or more of the xylFGH, rbsABC, or alsBAC operons).

In some embodiments, a microbial strain as shown in Table II is provided. In some embodiments, the strain is one of BOP330, BOP336, BOP338, BOP370, BOP372, BOP374, BOP 374e, BOP384, BOP384e1, BOP384eG2. In some embodiments, the strain is BOP374e. In some embodiments, the strain is BOP384eG1. In some embodiments, the strain is BOP384eG2. Any of strains BOP374e, BOP384eG1, and BOP384eG2 or any of the other strains described herein can be deposited in an acceptable depository under the Budapest Treaty on the International Recognition of the Deposit of Microorganisms for the Purposes of Patent Procedure.

In some embodiments, a genetically engineered microbial organism comprising a genetic modification which substantially reduces pyruvate format lyase (PFL) activity and a genetic modification which substantially reduces pyruvate dehydrogenase (PDH) activity is provided, and further comprises at least one of the mutations listed in Table VIa. In some embodiments, the strain further comprises at least one mutation selected from the group consisting of (each numerical position listed is with reference to SEQ ID NO: 1): C→T, 111897 G→A, 1135244 A→G, 1137595 A→G, 1163111 A→G, 1247873 G→A, 1260197 C→T, 1274794 T→C, 1386732 A→G, 1435247 Δ1 bp, 1440978 G→A, 1580390 A→G, 1604028 T→C, 1610530+C, 1679479 T→C, 1682336 A→G, 1729483 G→A, 1760136 G→A, 1866695 G→A, 1929016 G→A, 1950262 G→A, 1976527 Δ776 bp, 2071288 G→A, 2085304+G, 2098010 T→C, 2257220 A→G, 2358479+C, 2405257 G→C, 2534334 Δ1::IS186 (−)+6 bp::Δ1, 2620968 Δ1 bp, 2662540 T→C, 2732557+C, 2740321 T→C, 2763809+C, 2767188 G→A, 2782127 A→G, 2809146+A, 2824039 T→C, 2826646 G→A, 2844070 G→A, 2926442+T, 2927497 G→A, 2932138 T→A, 2965591 T→C, 2975919 T→C, 3114125 C→T, 3176882 G→A, 3218853 T→C, 3246033 G→A, 3268091 C→T, 3268123 C→A, 3268165 C→T, 3279141 C→T, 3302829 Δ1 bp, 3315496 A→G, 3335733 C→T, 34111+T, 3429378 T→C, 345189 A→G, 3506796 T→C, 3526004 T→C, 3548297 T→C, 379237 Δ1 bp, 379237 Δ2 bp, 386281 C→T, 3955730 G→A, 3957957 C→T, 3978813 C→A, 3982057 C→T, 3983344 C→T, 3990407 Δ8 bp, 407943 A→G, 4105271 A→G, 4153541 A→G, 42111 C→A, 4234068 T→G, 4294403+C→G, 4306572 3434 bp-→82 bp, 4444833 A→G, 4503718 G→A, 454725 C→T, 4604230+G, 4604346 Δ1 bp, 507894 T→C, 533362 A→G, 547694 A→G, 547831+G, 558493 G→T, 560913+G, 619171 A→G, 653396 T→C, 696062 G→A, 700027 C→T, 700286+C, 700599+C, 700679+G, 751964 C→T, 760544 C→T, 844446 C→T, 852434+A, 922473+G, 961467 C→T, and 963462 A→G. It is noted that SEQ ID NO: 1 represents a genomic sequence of wild-type *E. coli* K-12 MG1655, but that it is contemplated that any or all of the indicated mutations (or a corresponding mutation in a respective host genome) can readily be applied to a different microbial strain or species as described herein. In some embodiments, the microbial strain comprises at least 2 of these mutations, for example 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 5, 54, 55, 56, 57, 58, 59, 60, 91, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, or 103 of these mutations, including ranges between any two of the listed values. In some embodiments, the microbial strain comprises all of the indicated mutations in one of BOP384' Day 0 (see SEQ ID NO: 2), BOP384G1D' Day 3 (see SEQ ID NO: 3), BOP384G1H' Day 5 (see SEQ ID NO: 4), BOP384G1N' Day 8 (see SEQ ID NO: 5), BOP384G1S' Day 10 (see SEQ ID NO: 6), BOP384G1X' Day 13 (see SEQ ID NO: 7), BOP384eG1' (isolate 1) Day 14 (see SEQ ID NO: 8), or BOP384eG1' (isolate 2) Day 14 (see SEQ ID NO: 9) as shown in Tables VIb and VIc. In some embodiments, the microbial strain comprises at least one fewer mutation than the set of mutations identified in BOP384' Day 0 (see SEQ ID NO: 2), BOP384G1D' Day 3 (see SEQ ID NO: 3), BOP384G1H' Day 5 (see SEQ ID NO: 4), BOP384G1N' Day 8 (see SEQ ID NO: 5), BOP384G1S' Day 10 (see SEQ ID NO: 6), BOP384G1X' Day 13 (see SEQ ID NO: 7), BOP384eG1' (isolate 1) Day 14 (see SEQ ID NO: 8), or BOP384eG1' (isolate 2) Day 14 (see SEQ ID NO: 9) as shown in Tables VIb and VIc, for example at least one, two, three, four, five, six, seven, eight, nine, or ten fewer mutations. In some embodiments, the microbial strain comprises the set of mutations identified in BOP384' Day 0 (see SEQ ID NO: 2), BOP384G1D' Day 3 (see SEQ ID NO: 3), BOP384G1H' Day 5 (see SEQ ID NO: 4), BOP384G1N' Day 8 (see SEQ ID NO: 5), BOP384G1S' Day 10 (see SEQ ID NO: 6), BOP384G1X' Day 13 (see SEQ ID NO: 7), BOP384eG1' (isolate 1) Day 14 (see SEQ ID NO: 8), or BOP384eG1' (isolate 2) Day 14 (see SEQ ID NO: 9) as shown in Tables VIb and VIc, plus at least one additional mutation identified in Table VIa, for example one, two, three, four, five, six, seven, eight, nine, or ten additional mutations identified in Table VIa.

In some embodiments, a microbial strains as shown in Table II undergoes adaptive evolution. In some embodiments, a pflABfocA pflDC aceEF strain or a strain having a phenotype corresponding to that of a pflABfocA pflDC aceEF strain undergoes adaptive evolution. In some embodiments, a BOP338 strain undergoes adaptive evolution. In some embodiments, a BOP374e strain undergoes adaptive evolution.

It can be useful for a microbial strain to have desirable uptake and/or production characteristics under growing conditions that are adaptable to an industrial scale. In some embodiments, microbial strains as described herein have desirable production characteristics (e.g. product yield and volumetric productivity) at growth densities in a range consistent with industrial production. Exemplary descriptions of microbial strain production at industrial scales can be found in Chang et al. 1999; Dien et al. 2001; Zhou et al. 2003; and Zhu et al. 2007)

According to some embodiments herein, microbial strains with carbohydrate uptake and/or production capabilities near, at, or above the theoretical maximum are provided. In some embodiments, the theoretical production maximum of a microbial strain is as provided in Feist et al., 2010. In some embodiments, lactate production strains as provided herein provide superior performance in terms of production rate, growth rate, and/or byproduct formation as compared to other lactate-producing strains. In some embodiments, lactate production strains as provided herein provide superior performance in terms of production rate, growth rate, and/or byproduct formation as compared to the theoretical maximum. Exemplary characteristics of lactate-producing strains can be found in Fong et al., 2005, Chang et al. 1999; Dien et al. 2001; Zhou et al. 2003; Zhu et al. 2007.

In some embodiments, a strain is provided having an uptake rate of at least about 30 mmol per grams dry weight per hour (mmol $gDW^{-1}$ $hr^{-1}$) under standard conditions in 1 g per liter yeast extract medium, for example about 30 mmol $gDW^{-1}$ $hr^{-1}$, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 mmol $gDW^{-1}$ $hr^{-1}$, including ranges between any two of the listed values. In some embodiments, the strain may provide more than 100 mmol $gDW^{-1}$ $hr^{-1}$. In some embodiments, the uptake rate is at least about 20.7 mmol $gDW^{-1}$ $hr^{-1}$. In some embodiments, the uptake rate is at least about 43.1 mmol $gDW^{-1}$ $hr^{-1}$. In some embodiments, the substrate for uptake is glucose. In some embodiments, D-lactate is produced from the glucose.

In some embodiments, a strain is provided having a production rate of at least about 30 mmol per grams dry weight per hour (mmol $gDW^{-1}$ $hr^{-1}$) under standard conditions in 1 g per liter yeast extract medium, for example about 30 mmol $gDW^{-1}$ $hr^{-1}$, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190 or 200 mmol $gDW^{-1}$ $hr^{-1}$, including ranges between any two of the listed values. In some embodiments, the strain may provide more than 200 mmol $gDW^{-1}$ $hr^{-1}$. In some embodiments, the substrate is glucose and the product is D-lactate. In some embodiments, the glucose uptake rate is 18 mmol $gDW^{-1}$ $hr^{-1}$ and minimal medium conditions are used.

In some embodiments, a strain is provided having a growth rate of at least about 0.2 $hr^{-1}$ is provided, for example a growth rate of about 0.2 $hr^{-1}$, 0.25, 0.26, 0.3, 0.35, 0.4, 0.45, 0.5, 0.55, 0.6, 0.65, 0.7, 0.75, 0.8, 0.85, 0.86, 0.9, 0.95, 1, 1.05, 1.1, 1.15, 1.2, 1.25, 1.3, 1.35, 1.4, 1.45, 1.5, 1.55, 1.6, 1.65, 1.7, 1.75, 1.8, 1.85, 1.9, 1.95, or 2 $hr^{-1}$, including ranges between any two of the listed values. In some embodiments, a strain having a growth rate of more than 2 $hr^{-1}$ is provided.

Additional Alternative Embodiments

Traditional metabolic engineering can require a high level of organism familiarity and biological intuition. However, with systems biology methods and genome-scale metabolic models, it is possible to reliably and systematically predict the phenotype of microbial organisms (Park et al. 2008). Successful cases of systems biology driven strain designs for *E. coli* include production of the metabolites lycopene (Alper et al. 2005a; Alper et al. 2005b), lactic acid (Fong et al. 2005), succinic acid (Lee et al. 2005; Lee et al. 2008; Wang et al. 2006), and amino acids (Lee et al. 2007; Park et al. 2007). These cases demonstrated in *E. coli* as well as those for additional organisms have been reviewed (Feist and Palsson 2008; Park et al. 2008) and represent examples of metabolic engineering driven by systems biology.

Although lactate production strains have been constructed previously (Chang et al. 1999; Dien et al. 2001; Zhou et al. 2003; Zhu et al. 2007), strains according to some embodiments herein can differ in one or more of the following aspects: (i) strains according to some embodiments herein can be generated without any recombinant DNA, thus streamlining the construction and fermentation process (e.g., no induction of a transgene is required), (ii) strains according to some embodiments herein do not require complex fermentations, such as two-stage aerobic and anaerobic fermentations; (iii.) strains according to some embodiments herein have the potential for continuous processing.

Model-driven design also has an advantage in that it offers a means to quickly predict the effect of additional knockouts and supplementation of medium, which was mostly speculative and performed by trial and error in other studies. One specific prediction from modeling was that acetyl-CoA could be generated in the pflABfocA, pflDC, aceEF knockout strain through pathways detailed in the model that were previously speculated not to be utilized (Zhu et al. 2007). The weaning of the strain off of acetate supplementation provides evidence that this is indeed possible; however the necessity of yeast extract for continued growth indicates that further testing is needed. Modeling predicted that the lactate produced here is optically pure D-lactate, as the predicted active enzyme is that of the D-lactate specific ldhA gene. Optically pure lactate is preferred for polymer generation (Hofvendahl and Hahn-Hagerdal 2000) and can be directly assayed in these strains. The next step for the evaluation of this lactate producing strain is evolution under continuous processing conditions and higher substrate conditions. Strains that are growth coupled are, in theory, suitable for continuous culture as they will not be outperformed by mutants that exhibit faster growth under such conditions. This continuous processing potential may significantly impact the field of metabolic engineering.

EXAMPLES

Example 1: Computational Model and in Silico Design

The metabolic reconstruction of *E. coli* iAF1260 (Feist et al. 2007) with the minor changes described (Feist et al. 2010) was utilized. This model has been functionally tested and verified against experimental data to accurately predict growth rates, metabolite excretion rates, and growth phenotypes on a number of substrate and genetic conditions (Feist et al. 2007). For all simulations, the reactions CAT, SPODM, and SPODMpp (oxidative stress reactions) and the FHL reaction were constrained to zero for reasons previously established (Feist et al. 2007). Flux balance analysis (Price et al. 2004) was used for computing optimal phenotypes using iAF1260 and the biomass objective function, BOF-CORE, with the reported maintenance energies presented with the reconstruction (Feist et al. 2007). All computations were performed using the MATLAB (The MathWorks Inc., Natick, Mass.) and the COBRA Toolbox (Becker et al. 2007) software packages with TOMLAB (Tomlab Optimization Inc., San Diego, Calif.) solvers.

Model conditions were set to computational minimal medium as previously defined (Feist et al. 2007). Minimal medium with yeast extract supplementation (for experimental comparison) was simulated by allowing amino acid and nucleotide base uptake rates for simulations in amounts proportional to that required for supporting a given experimentally determined growth rate computationally. In modeling terms, a given uptake rate for an amino acid or nucleotide base was equal to the stoichiometric coefficient of that component in the biomass objective function multiplied by the experimental growth rate. The growth and non-growth associated maintenance modeling parameters identified in model development for growth on glucose were used for all design calculations (Feist et al. 2007).

In order to improve computationally identified growth coupled knockout strains and reduce the number of knockouts necessary, a COBRA Toolbox function (Becker et al. 2007) called analyzeGCdesign (see Supplementary Files) was created. This function uses a simple algorithm and objective function to find a better growth coupled solution, given an OptKnock or OptGene solution (or any set of knockouts) as an input (Feist et al. 2010).

Example 2: Selection of Strain Designs

From the pool of computational designs (Feist et al. 2010), the production of D-lactate from glucose was identified as a production target as lactate was predicted to be a homofermentation product with a high yield. The original designs generated from the computational analysis gave two designs for three- and five-reaction knockouts that could result in the high yield phenotype (Table I). A sensitivity analysis using the analyzeGCdesign algorithm with a penalty for knockouts of 90% was performed on each of the designs to determine if the high yield could be sustained or improved with fewer metabolic interventions (i.e., knockouts). This analysis returned a two reaction removal design (reactions PFL, pyruvate formate lyase, and PDH, pyruvate dehydrogenase) as the optimal design for the given knockout penalty and maximization of yield starting from the three knockout design, and a single reaction removal (ALCD2x, alcohol dehydrogenase (ethanol)) starting from the five knockout design. The PFL and PDH design for the production of lactic acid from glucose was found to be a novel design based on a literature search, although similar designs exist (Zhou et al. 2003; Zhu et al. 2007), and it was selected for construction.

TABLE I

Results of computational analysis of strain designs for production of D-lactate from glucose.

| OptKnock Design | Production Rate (mmol gDW$^{-1}$ hr$^{-1}$) | Yield (wt %) | By-products | By-product Rate (mmol gDW$^{-1}$ hr$^{-1}$) | By-product Yield (wt %) | Growth Rate (hr$^{-1}$) | analyzeGC design Max Yield - 90% KO Penalty |
|---|---|---|---|---|---|---|---|
| PDH, PFL, PGI | 36.158 | 90.4% | succinate CO$_2$ | 0.087 0.51 | 0.3% 0.6% | 0.261 | PFL, PDH |

TABLE I-continued

Results of computational analysis of strain designs for production of D-lactate from glucose.

| OptKnock Design | Production Rate (mmol gDW$^{-1}$ hr$^{-1}$) | Yield (wt %) | By-products | By-product Rate (mmol gDW$^{-1}$ hr$^{-1}$) | By-product Yield (wt %) | Growth Rate (hr$^{-1}$) | analyzeGC design Max Yield - 90% KO Penalty |
|---|---|---|---|---|---|---|---|
| ALCD2x, ATPS4rpp, G6PDH2r, GHMT2r, PGI | 38.429 | 96.1% | acetate succinate CO$_2$ | 0.138 0.033 0.196 | 0.2% 0.1% 0.2% | 0.100 | ALCD2x |

Example 3: Strain Construction

The starting strain was wild-type *E. coli* K-12 MG1655 (ATCC 700926). This strain has been extensively characterized physiologically (Fong et al. 2005; Fong et al. 2003; Ibarra et al. 2002; Reed et al. 2006), and its genome has been resequenced (Herring et al. 2006. Nat Genet. 38(12):1406-1412, hereby incorporated by reference in its entirety). A genomic sequence of wild-type *E. coli* K-12 MG1655 is provided as SEQ ID NO: 1. The computational model iAF1260 is based on the K-12 MG1655 genome. Gene disruptions were performed using homologous recombination of PCR-amplified linear fragments (Datsenko and Wanner 2000). During the gene deletion process, strains were grown aerobically in LB liquid medium and on 1.0% agar plates and the antibiotics kanamycin, chloramphenicol, and ampicillin were used for section. The plasmids pKD46, pKD13, and pCP20 were used in this process. Strains were preserved at −80° C. and were given a systematic "BOP" tag and number (for example, BOP27) under a standard strain identifier protocol. Knockout genotypes were confirmed by PCR using pairs of locus-specific primers.

Three operons were removed to completely eliminate the activity of the two reactions in the design. Two operons for the PFL reaction, pflABfocA, the main isozyme and additionally the transporter that allows passage of the reaction by-product formate, and pflDC, the minor isozyme. Removal of one operon, aceEF, encoding the core of the pyruvate dehydrogenase catalyzing enzyme, eliminated the PDH reaction. These gene deletions were defined in the gene to protein to reaction associations in iAF1260 (Feist et al. 2007). The resultant strain was labeled BOP338 (Table II). The operons xylFGH, rbsACB, and alsBAC were also deleted in order to improve the strain's ability to grow on xylose, although it was only grown on glucose in this study. This strain was labeled BOP374 (Table II).

TABLE II

Strains according to some embodiments herein (SS—steady-state evolution, SPE—serial passage exponential)

| Strain | Parent | Evolution | Genotype |
|---|---|---|---|
| BOP27 | N/A | | MG1655 ATCC#47076 |
| BOP330 | BOP27 | | pflABfocA kan + |
| BOP336 | BOP331 | | pflABfocA pflDC kan + |
| BOP338 | BOP337 | | pflABfocA pflDC aceEF kan + |
| BOP370 | BOP339 | | pflABfocA pflDC aceEF xylFGH kan + |
| BOP372 | BOP371 | | pflABfocA pflDC aceEF xylFGH rbsACB kan + |
| BOP374 | BOP372 | | pflABfocA pflDC aceEF xylFGH rbsACB alsBAC kan + |
| BOP374e | BOP374 | SS, 16 days | pflABfocA pflDC aceEF xylFGH rbsACB alsBAC kan + |
| BOP384 | BOP374e | | pflABfocA pflDC aceEF xylFGH rbsACB alsBAC mutS kan + |
| BOP384eG1 | BOP384 | SPE, 14 days | pflABfocA pflDC aceEF xylFGH rbsACB alsBAC mutS kan + |
| BOP384eG2 | BOP384 | SPE, 14 days | pflABfocA pflDC aceEF xylFGH rbsACB alsBAC mutS kan + |

After construction of the production strain, it was analyzed for growth properties under the minimal medium conditions for which it was designed to be evolved and optimized in. Minimal media for cultures was selected as follows: M9 minimal was selected as it has been demonstrated that lactic acid can be made with the given defined minimal nutrients (Fong et al. 2005). Yeast extract (Sigma, Catalog #8013-01-2) and sodium acetate were used as supplementation where specified. This analysis was done in batch mode and the results are shown in Table III. The screen revealed that the lactate production strain constructed was auxotrophic for acetate. This indicates that the strain was not able to make the necessary acetyl-CoA required for generation of lipids. With the strain containing PFL and PDH knockouts, this result was not unexpected. These growth rates could potentially increase with adaptation to these conditions. Furthermore, supplementation with yeast extract, a widely used culture supplement (see below) also increased the growth rate in a few instances examined, but could not support growth as the only supplement along with glucose (data not shown).

TABLE III

Initial growth characteristics of production strains (NG—no growth)

| Strain | Culture Conditions | Supplement | Aerobicity | Growth Rate (hr$^{-1}$) |
|---|---|---|---|---|
| BOP338 | 4 g/L glucose M9 | none | aerobic | NG |
| BOP338 | 4 g/L glucose M9 | 1 g/L acetate | aerobic | 0.37 |
| BOP374 | 4 g/L glucose M9 | none | aerobic | NG |
| BOP374 | 4 g/L glucose M9 | 1 g/L acetate | aerobic | 0.43 |
| BOP374 | 4 g/L glucose M9 | none | anaerobic | NG |
| BOP374 | 4 g/L glucose M9 | 1 g/L acetate | anaerobic | 0.16 |

Examples 4-5

Continuous Culture Evolutions

Continuous culture was performed in a 1.0 L New Brunswick BioFlo fermentor. M9 medium was used in the fermentor as specified. The agitation rate was 500 RPM and was constant for the run. Temperature was maintained at 37° C. Culture pH was maintained with 5% NaOH and was maintained at 7.0. Dissolved oxygen was also monitored for the evolution and was maintained at zero. The volume of medium in the fermentor was maintained at 1.0 L unless noted otherwise. To maintain anoxic conditions in the fermentor, 5% CO2 balance $N_2$ gas was supplied to the fermentor at 1 VVM. For the weaning off of acetate, the glucose concentration was 4.0 g/L and the acetate was at 2.0 g/L. Feed rates are presented in the results section as a function of time. Samples were removed aseptically and optical density measurements were taken. Samples were analyzed by HPLC.

Products were identified and quantified by HPLC using an Aminex 87-H ion exchange column at 65° C. The mobile phase was 5 mM H2SO4 at an isocratic flow of 0.5 mL/minute. Sample injection volume was 10 μL. Products were identified by retention time using utilizing ultraviolet detection at 210 nm and refractive index detection at 30° C. internal temperature and 45° C. external temperature and quantified by relating peak area to those of standards.

Adaptive evolution was conducted in 100 mL flasks with M9 medium supplemented with 4.0 g/L glucose. Other supplements are stated in the Results section. Cultures were maintained at 37° C. in an anaerobic chamber with the atmospheric gas being a mixture of 7.5% H2/10% CO2 with balance $N_2$. Experiments were designed to keep cells growing in exponential growth phase. To do this, the inoculum volume was changed for each passage throughout the course of evolution, and passages were performed at an optical density of approximately 0.2. Cultures were frozen and stored at −80° C. at regular intervals throughout adaptive evolution, approximately every other day.

Example 4: Adaptive Evolution to Alleviate Acetate Auxotrophy

Figure 2:
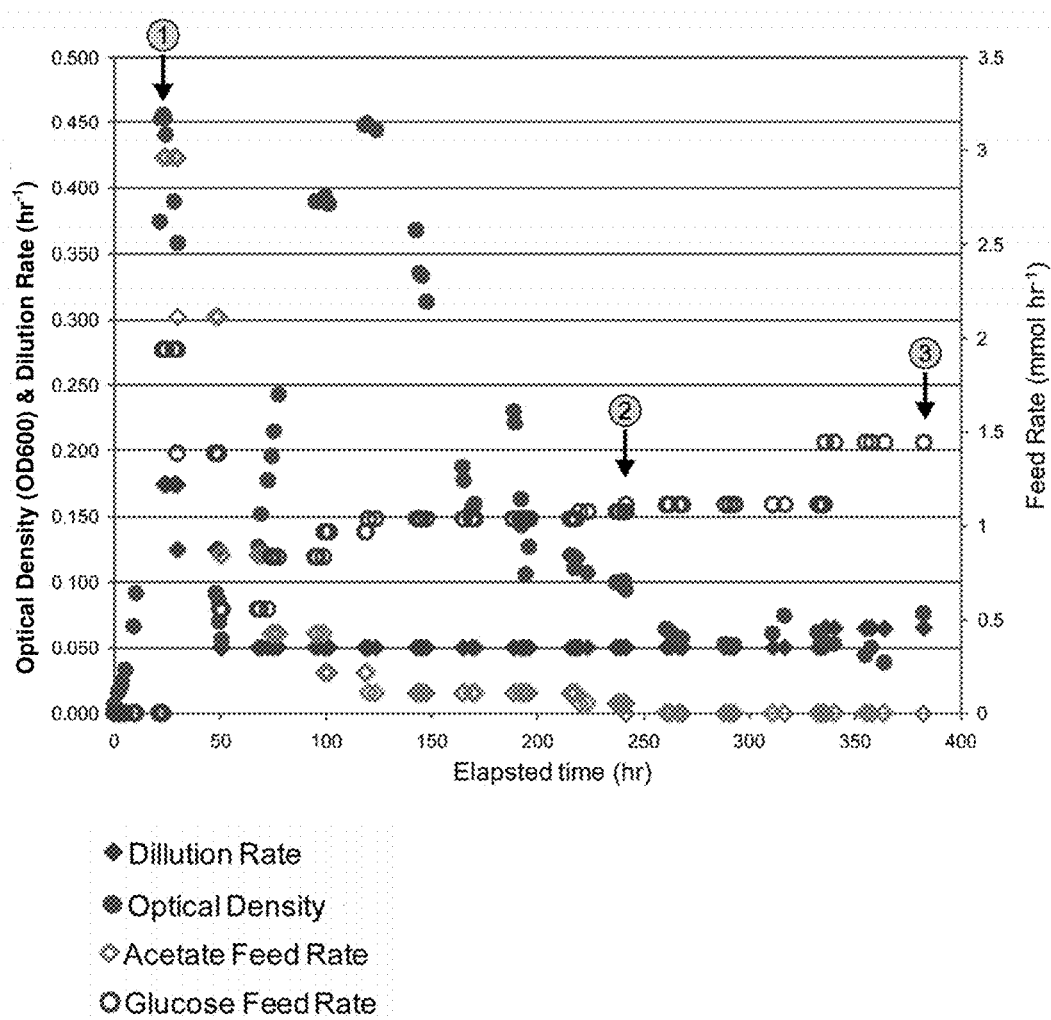
FIG. 2 is a graph illustrating continuous culture adaptive evolution of strain BOP374 to remove acetate auxotrophy according to some embodiments herein. Three different time points are denoted, (1) the time at which continuous culture was initiated, (2) the point at which acetate feed to the culture was ended, and (3) the time at which a strain was collected. The dilution rate (hr$^{-1}$), optical density (OD600), and feed rates for glucose and acetate (mmol hr$^{-1}$) are given. As the acetate feed was decreased, the cellular density decreased. At point 3, the evolution resulted in isolation of a strain that could grow solely on glucose.

Adaptive evolution was also used to alleviate the acetate auxotrophy. BOP374 was evolved in a 1.0 L chemostat anaerobically with a stepwise decreasing acetate feed rate (FIG. 2). To do this, the strain was initially inoculated into the fermentor in a batch mode with a glucose and acetate mixture, after the culture grew up to an appreciable density (point 1), the culture was run in continuous culture mode for 16 days, during which the acetate feed rate was sequentially lowered until the strain was growing solely on glucose minimal medium (point 2). At the end of the evolution, a colony was isolated from the fermentor and was designated and preserved with a new strain number (point 3). Continuous culture was chosen for the evolution as it allowed for automation and monitoring of the process along with a straightforward procedure to drop auxotrophy feed rates. The evolved strain harvested at the end of the evolution was confirmed to have the same genotype as the starting strain (in terms of gene knockouts) and was designated BOP374e.

Example 5: Adaptive Evolution to Optimize Production Phenotypes

In order to increase the rate of mutation and subsequently reduce the time necessary to evolve strains to an optimal phenotype, the mutS gene was removed from strain BOP374e to generate the mutator strain BOP384 (Table II). The mutS gene is involved in DNA mismatch repair (Acharya et al. 2003; Schlensog and Bock 1991), thus its removal can cause a substantial increase in the mutation rate of E. coli (Giraud et al. 2001; Shaver et al. 2002).

Figure 3:
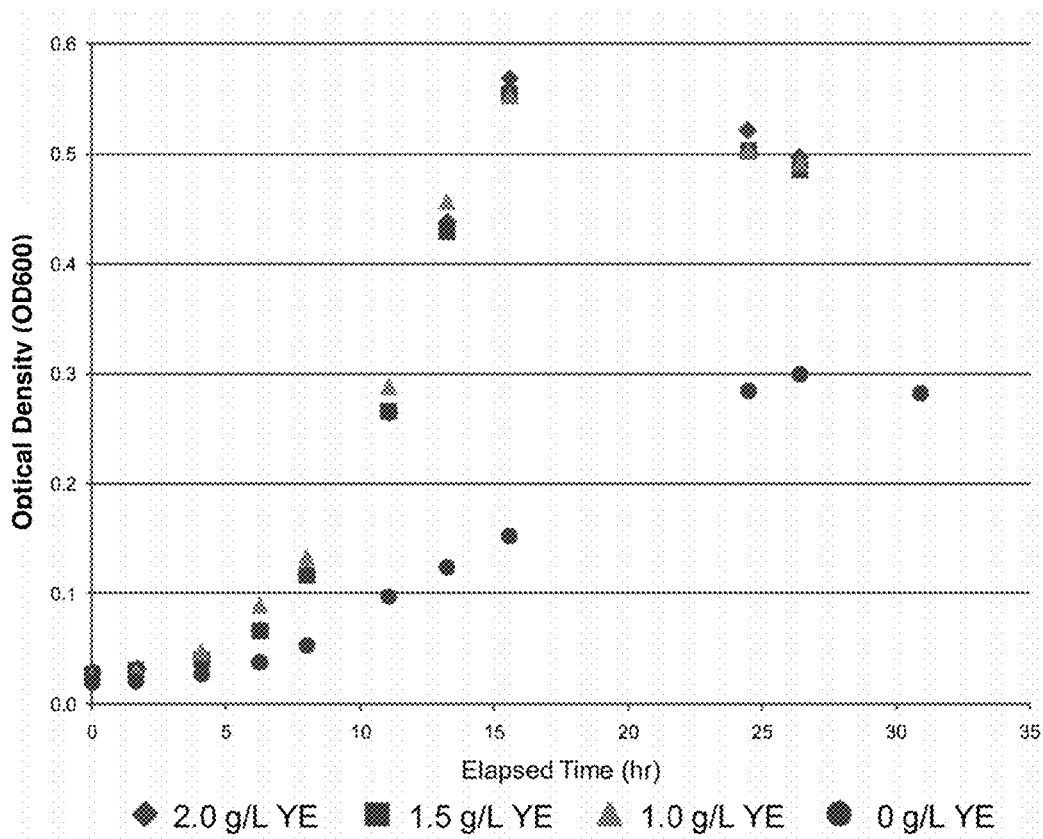
FIG. 3 is a graph illustrating growth characteristics of microbial cells according to some embodiments herein. BOP384, the lactate production strain was examined for its growth on glucose minimal medium with and without supplementation of yeast extract (YE) at different levels. All levels of supplementation had a similar growth profile and final optical density, both greater than those for no supplementation.
Figure 4:
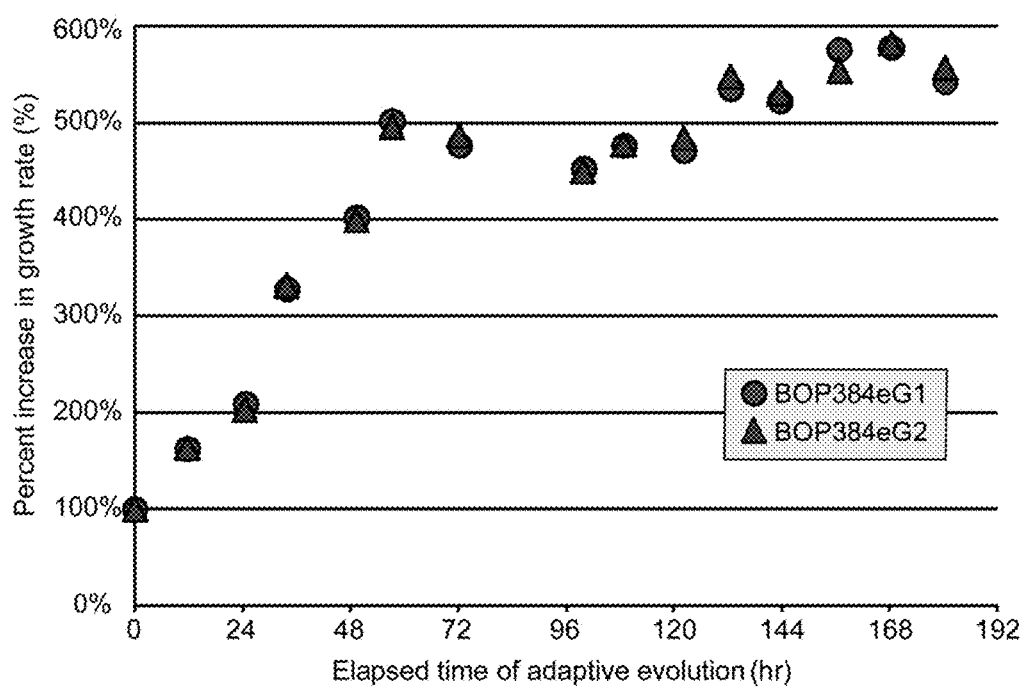
FIG. 4 is a graph illustrating the percent increase of growth rate by adaptively evolved strains according to some embodiments herein. Growth rate over an initial unevolved lactate production strain (e.g. strain BOP384) is shown over time for strains evolved on glucose. The strain was evolved in duplicate in parallel evolutions. The initial growth rates were determined each on glucose and the same starting strain was used for both evolutions. Both duplicates (BOP384eG1 and BOP384eG2) possessed a similar growth rate path to the end phenotype and similar final endpoint growth rates.

Initial characterization of the lactate production strain revealed that supplementation of the medium with yeast extract (YE) was necessary to sustain anaerobic growth during the adaptive evolution process. Strains growing with supplementation all possessed approximately the same growth profile and production characteristics when compared to the unsupplemented culture (FIG. 3). For the supplemented cultures, the maximum growth rate was 0.26±0.01 hr-1. The culture without supplementation had a maximum growth rate of 0.20 hr-1 during exponential phase. The overall batch product yields, Yp/s, are given in Table IV. After BOP384 growing with no supplementation was passed to fresh medium (with the same initial composition, no supplementation) under anaerobic conditions, growth ceased in numerous attempts after approximately two to three culture doublings (results not shown), further justifying the choice of medium supplementation with yeast extract BOP384 was evolved in duplicate on glucose using the established batch serial passage adaptive evolution process to keep the population in exponential growth phase (see Materials and Methods). The starting strain was unevolved BOP384 supplemented with 1.0 g/L YE (characteristics are shown in Table IV). Both of the duplicate evolutions resulted in endpoint strains with very similar growth and production profiles. The percent increase over the initial 0.26±0.01 hr-1 growth rate after the first 200 hours of the entire evolution (which was about 14 days total) was roughly 500%, as shown in FIG. 4. There was a rapid increase in the growth rate during the adaptation with the cultures reaching their final growth rates in about 2.5 days. This adaptation period of 2.5 days is much less than that of E. coli in other adaptive evolution experiments in which strains reached their final growth rate in 10-30 days (Fong and Palsson 2004; Ibarra et al. 2002). The final growth rate anaerobically was much higher than observed in earlier studies. In total, the evolution process was carried out for slightly over 14 days until the growth rate stopped increasing. Single colonies were isolated from the final cultures of each evolution (after 14 days), their knockout genotypes were confirmed by PCR, and they were designated as BOP384eG1 and BOP384eG2.

Strains BOP384eG1 and BOP384eG2 were cultured from frozen stocks and examined for their production capabilities. It is noted that the growth rates of the indicated populations are illustrated reported in FIG. 4, whereas clonal isolates are exampled and reported in Table IV. Furthermore, growth rates from FIG. 4 may include overestimates due to characteristic dilution error that can occur when calculating the expected small inoculation sizes. Nonetheless, the increase in growth phenotype is significant.

Example 6: Growth Rates, Culture Doublings, and Division Events of Engineered Microbial Strains Cell concentration in cultures was determined by measuring the optical density at 600 nm (OD600) using a Biomate 3 spectrophotometer (Thermo Scientific, USA). A value of 1.55*1012 cells L-10D600$^{-1}$ was used to calculate cell numbers with a dry cell weight of 2.9*10-13 gDW cell$^{-1}$ (Neidhardt 1996). Total biomass can be calculated as 0.45 gDW L$^{-1}$ OD600$^{-1}$. Growth rates of batch cultures during exponential growth were determined using at least three cell and metabolite concentration data points.

The mutations that accumulate during adaptive evolution occur randomly during cell division, so it was useful to calculate the total number of cell doublings that have occurred at any time. The formula used for this was D=($2^G$−1)*I where D is the total number of cellular division events, I is the initial number of cells, and G is the number of cell divisions per initial cell (the number of generations). One doubling occurred for every new cell in the culture.

Characterization of the final lactate producing strains indicated evolution to a production phenotype in agreement with computational predictions. Table IV contains data from the characterization of the endpoint strains. The final production rate of lactate was 84.4±1.5 mmol gDW$^{-1}$ hr$^{-1}$ and additionally succinate was made a rate of 4.3±0.3 mmol gDW$^{-1}$ hr$^{-1}$. This correlated to a 97.9±1.2% and 6.5±0.3% wt % product yield at steady-state during the exponential growth phase for lactate and succinate, respectively. Overall percent product yields for lactate and succinate were 98.4±3.4% and 3.4±2.8% wt %, respectively. The overall yield was monitored throughout the evolution and was consistent at these values after 2.5 days of evolution. The steady-state production rate of lactate increased over 2 fold for the endpoint strain compared to the unevolved strain. The glucose consumption rate also has a similar 2 fold increase, and the production rate of succinate increased 7 fold. The steady-state wt % yield for lactate was approximately the same and that of succinate increased approximately 3.5 fold. The overall wt % yields were approximately the same for both lactate and succinate. The summation of the wt % yields over 100% indicate that some of the supplemented yeast extract was contributing to the lactate and/or succinate production. Overall, 93.8% of the total product generated during fermentation at steady-state was lactate, close to the homofermentative criteria set for the strain in the computational selection of strain designs.

Figure 5:
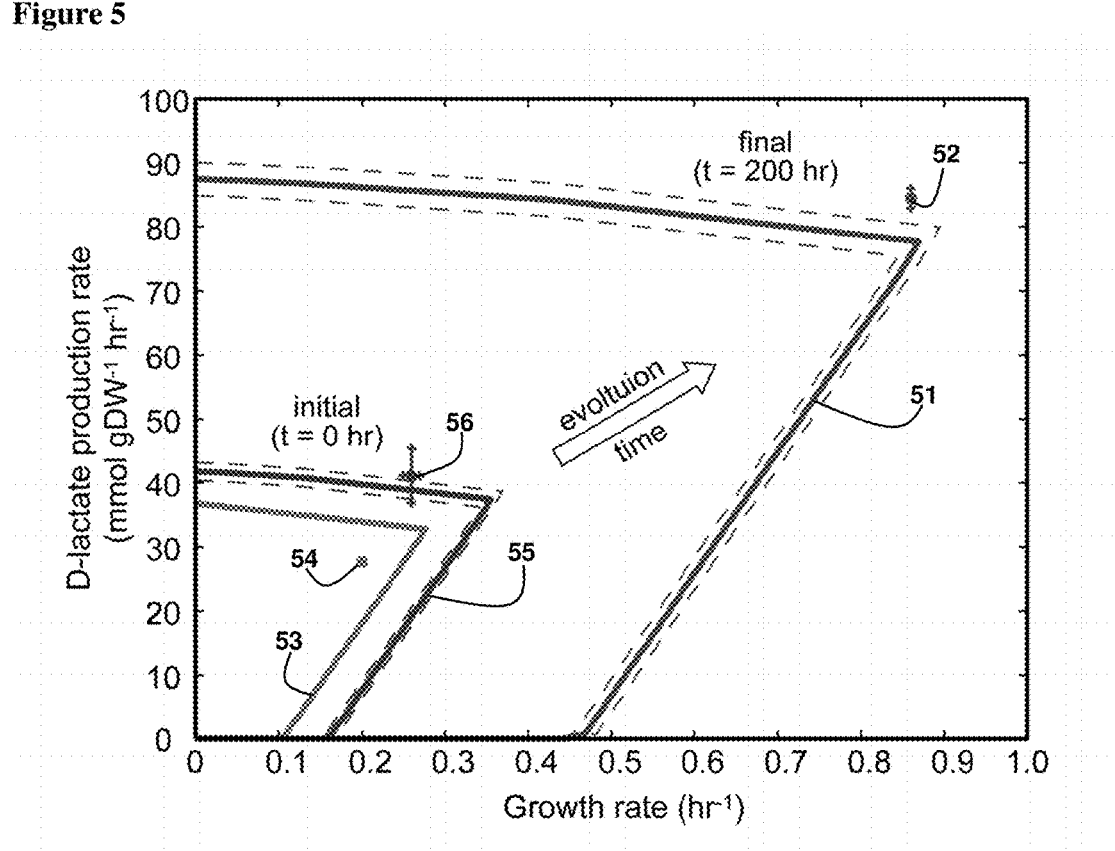
FIG. 5 is a graph illustrating the predicted production envelopes and experimental production measurements for unevolved and end point lactate production strains (BOP384, BOP384eG1, and BOP384eG2). The production envelopes are given based on experimentally measured substrate uptake rates (mmol gDW$^{-1}$ hr$^{-1}$), solid lines (averages) and dashed lines (considering standard deviation). Also plotted are the experimentally measured values for the lactate production rates (mmol gDW$^{-1}$ hr$^{-1}$) and growth rates (hr$^{-1}$). Experimental values are given in Table IV. The line 51 and point 52 are for the endpoint strain (with error bars); line 53 is the unevolved strain without supplementation (single measurement 54); and line 55 and point 56 are for the unevolved strain with yeast extract supplementation. For the endpoint, the optimal growth rate value for the envelopes lies near the experimentally determined endpoint growth rate and lactate production rate. The evolution resulted in a significant increase in production and growth rates.

The data from the unevolved and evolved strains (including strains according to some embodiments herein) on glucose analyzed with the iAF1260 model is shown in FIG. 5. The computational predictions and experimentally evolved endpoint measurements display good agreement. For the measurement of unevolved, unsupplemented growth on glucose, the initial phenotype is suboptimal with the production rate and growth rate less than the optimally predicted point. Coincidentally, the glucose uptake rate of 18.4 is almost identical to that observed for anaerobic growth of E. coli in an earlier modeling and experimental evaluation of growth (Varma and Palsson 1994) and gives confidence in the single measurement. Supplementation with yeast extract for unevolved glucose growth displays near optimal behavior as predicted with the model at the measured uptake rate. This demonstrates that yeast extract allows more incoming carbon (glucose and yeast extract content) to be used for lactate production and for biomass generation. The endpoint predictions and experimental measurements are in good agreement, with the experimentally measured growth rate and lactate production rate contributing to a point very near the optimal growth rate. The increased growth and production rates are due to the over 2 fold increase in the glucose uptake rate. This characterization of an adaptively evolved production strain demonstrates that a computationally designed strain can result in an experimentally verified production phenotype in good agreement with modeling predictions.

The endpoint strains (see Table IV and FIG. 5) display superior performance in terms of production rate, growth rate, and by-product formation over previously generated lactate production strains (Fong et al. 2005). In comparison to lactate production studies on an industrial scale, the steady-state and overall yields generated in this study of 0.98 g g$^{-1}$ are at the same level or above previously reported values of 0.9 g g$^{-1}$ (Chang et al. 1999), 0.93 g g$^{-1}$ (Dien et al. 2001), 1.0 g g$^{-1}$ (Zhou et al. 2003), and 0.86 g g$^{-1}$ (Zhu et al. 2007). Furthermore, even at the relatively low cellular densities used for this process, a volumetric productivity of 1.7 g L$^{-1}$ hr$^{-1}$ was achieved, comparing favorably with previous studies where cell densities were driven roughly an order of magnitude higher and productivity values of 0.7-3.5 g L$^{-1}$ hr$^{-1}$ were reported (Chang et al. 1999; Dien et al. 2001; Zhou et al. 2003; Zhu et al. 2007). The overall product yield is very close to theoretical maximum for a growing strain (Feist et al. 2010), and is even above the theoretical value when considering supplementation.

TABLE IV

Characterization of the lactate production strain BOP384 prior to and after evolution (% $Y_{p/s}$—percent production yield, Supp.—supplement, YE—yeast extract).

| Evolution Status | Supp. | Growth Rate (hr$^{-1}$) | Product/ Substrate | Production/ Consumption Rate (mmol gDW$^{-1}$ hr$^{-1}$) | % $Y_{p/s}$ Steady-State (wt %) | % $Y_{p/s}$ (wt %) |
|---|---|---|---|---|---|---|
| unevolved | 1, 1.5, 2 g/L YE | 0.26 ± 0.01 | glucose | 20.7 ± 0.7 | | |
| | | | lactate | 41.1 ± 4.2 | 99.7 ± 0.1% | 101.3 ± 6.4% |
| | | | succinate | 0.6 ± 0.1 | 1.8 ± 0.4% | 3.7 ± 0.5% |
| unevolved | none | 0.2 | glucose | 18.4 | | |
| | | | lactate | 27.7 | 75.30% | 97.30% |
| | | | succinate | 0 | 0% | 3.90% |
| evolved | 1 g/L YE | 0.86 ± 0.00 | glucose | 43.1 ± 1.3 | | |
| | | | lactate | 84.4 ± 1.5 | 97.9 ± 1.2% | *98.4 ± 3.4% |
| | | | succinate | 4.3 ± 0.3 | 6.5 ± 0.3% | *3.4 ± 2.8% |

*Overall yield monitored throughout evolution and was consistent after 2.5 days.

Example 7: Genomic Sequencing of Selected Microbial Strains

Clonal isolates of each of the strains indicated in Table V were taken along the course of the roughly 14 day evolution, sequenced, and compared to the wild type and starting strains. The following is a list of isolates which were sequenced:

TABLE V

Strains selected for sequencing
Strain selected for sequencing
(timepoint in evolution is indicated, if applicable)

'BOP27'-Wild Type-ATCC 700926
'BOP384' Day 0
'BOP384G1D' Day 3
'BOP384G1H' Day 5
'BOP384G1N' Day 8
'BOP384G1S' Day 10
'BOP384G1X' Day 13
'BOP384eG1' isolate 1 Day 14
'BOP384eG1' isolate 2 Day 14

Genomic DNA was isolated using Promega's Wizard DNA Purification Kit. The quality of DNA was assessed with UV absorbance ratios using a Nano drop. DNA was quantified using Qubit dsDNA High Sensitivity assay. Paired-end resequencing libraries were generated using Illumina's Nextera XT kit with 1 ng of input DNA total. The sequencing results were analyzed using the breseq analysis software.

Sequences of each strain that was sequenced were compared to a wild-type reference sequence, SEQ ID NO: 1. Mutations identified in the analysis, including the affected gene, if any, and the affected protein, if any, are shown in Table VIa. The mutations identified in each sequenced strain (recovered at various timepoints) and the location of the mutations are shown in Tables VIb and VIc in which "TRUE" indicates the presence of a mutation in a particular strain and a "blank" entry indicates that the wildtype sequence is present at that location in a particular strain. Thus, from Tables VIb and VIc, the complete genomic sequence of each strain may be determined. The mutations found in each of the following strains are annotated in SEQ ID NOs: 2-9, as indicated in Tables VIb and VIc.: BOP384' Day 0 (see SEQ ID NO: 2), BOP384G1D' Day 3 (see SEQ ID NO: 3), BOP384G1H' Day 5 (see SEQ ID NO: 4), BOP384G1N' Day 8 (see SEQ ID NO: 5), BOP384G1S' Day 10 (see SEQ ID NO: 6), BOP384G1X' Day 13 (see SEQ ID NO: 7), BOP384eG1' (isolate 1) Day 14 (see SEQ ID NO: 8), or BOP384eG1' (isolate 2) Day 14 (see SEQ ID NO: 9).

TABLE VIa

Mutations Identified from Genomic Sequencing

| Mutation Position & Nucleotide change (with reference to SEQ ID NO: 1) | Gene | Protein change |
| --- | --- | --- |
| 1022011 C→T | yccS | A366T (GCT→ACT) |
| 111897 G→A | yacF | Q235* (CAG→TAG) |
| 1135244 A→G | flgH | D153G (GAC→GGC) |
| 1137595 A→G | flgJ/flgK | intergenic (+60/-6) |
| 1163111 A→G | thiK | H210R (CAC→CGC) |
| 1247873 G→A | dhaM | A155A (GCC→GCT) |
| 1260197 C→T | prs | R301H (CGT→CAT) |
| 1274794 T→C | narL | S87G (AGC→GGC) |
| 1386732 A→G | tpx | L35P (CTG→CCG) |
| 1435247 Δ1 bp | micC | intergenic (-330/+37) |
| 1440978 G→A | ldhA/ydbH | intergenic (-111/-97) |
| 1580390 A→G | ydeN | S53S (AGT→AGC) |
| 1604028 T→C | lsrB | G318G (GGT→GGC) |
| 1610530 + C | yneH | coding (746/927 nt) |
| 1679479 T→C | folM | D160D (GAT→GAC) |
| 1682336 A→G | tus | E18E (GAA→GAG) |
| 1729483 G→A | lhr | P791P (CCG→CCA) |
| 1760136 G→A | sufC | P134L (CCG→CTG) |
| 1866695 G→A | yeaG | M588I (ATG→ATA) |
| 1929016 G→A | purT | M38M (GTG→ATG) |
| 1950262 G→A | yecE/yecN | intergenic (+25/-28) |

TABLE VIa-continued

Mutations Identified from Genomic Sequencing

| Mutation Position & Nucleotide change (with reference to SEQ ID NO: 1) | Gene | Protein change |
|---|---|---|
| 1976527 Δ776 bp | flhD/insB-5 | |
| 2071288 G→A | flu | D576N (GAT→AAT) |
| 2085304 + G | yoeI/yeeY | intergenic (-166/+49) |
| 2098010 T→C | gnd | Y428C (TAC→TGC) |
| 2257220 A→G | pscK | G33G (GGT→GGC) |
| 2358479 + C | yfaW | coding (958/1206 nt) |
| 2405257 G→C | lrhA/yfbQ | intergenic (-594/-326) |
| 2534334 Δ1 :: IS186 (-) + 6 bp :: Δ1 | crr | coding (479-484/510 nt) |
| 2620968 Δ1 bp | purN/ppk | intergenic (+74/-98) |
| 2662540 T→C | yfhR | G43G (GGT→GGC) |
| 2732557 + C | yfiH | coding (500/732 nt) |
| 2740321 T→C | yfiR | V142A (GTC→GCC) |
| 2763809 + C | yfjM/rnlA | intergenic (-11/-131) |
| 2767188 G→A | yfjQ | D168N (GAT→AAT) |
| 2782127 A→G | ypjB | pseudogene (907/1374 nt) |
| 2809146 + A | mpTRUE | coding (355/531 nt) |
| 2824039 T→C | srlA | G62G (GGT→GGC) |
| 2826646 G→A | gutM | V2M (GTA→ATA) |
| 2844070 G→A | hycE | P142S (CCG→TCG) |
| 2926442 + T | sdaC | coding (192/1290 nt) |
| 2927497 G→A | sdaC | G416D (GGT→GAT) |
| 2932138 T→A | fucA/fucP | intergenic (-428/-119) |
| 2965591 T→C | ptsP | N289S (AAC→AGC) |
| 2975919 T→C | lysA | T335A (ACC→GCC) |
| 3114125 C→T | yghJ | V1004M (GTC→ATC) |
| 3176882 G→A | tolC | R249H (CGC→CAC) |
| 3218853 T→C | ygjG | R446R (CGT→CGC) |
| 3246033 G→A | yqjA | S80N (AGC→AAC) |
| 3268091 C→T | yhaC/rnpB | intergenic (+467/+556) |
| 3268123 C→A | yhaC/rnpB | intergenic (+499/+524) |
| 3268165 C→T | yhaC/rnpB | intergenic (+541/+482) |
| 3279141 C→T | agaW/agaA | pseudogene (49/555 nt) |
| 3302829 Δ1 bp | mtr | coding (1011/1245 nt) |
| 3315496 A→G | nusA | L18P (CTA→CCA) |
| 3335733 C→T | mlaC | D61N (GAT→AAT) |
| 34111 + T | carB/caiF | intergenic (+73/-189) |

TABLE VIa-continued

Mutations Identified from Genomic Sequencing

| Mutation Position & Nucleotide change (with reference to SEQ ID NO: 1) | Gene | Protein change |
|---|---|---|
| 3429378 T→C | rimN | E20E (GAA→GAG) |
| 345189 A→G | yahN | Y125H (TAT→CAT) |
| 3506796 T→C | yhfW | H347R (CAC→CGC) |
| 3526004 T→C | yrfF | V505A (GTG→GCG) |
| 3548297 T→C | malP | K733K (AAA→AAG) |
| 379237 Δ1 bp | frmR/yaiO | intergenic (−132/+56) |
| 379237 Δ2 bp | frmR/yaiO | intergenic (−132/+55) |
| 386281 C→T | tauC | G29G (GGC→GGT) |
| 3955730 G→A | ilvY | R38R (CGC→CGT) |
| 3957957 C→T | ppiC/yifO | intergenic (−121/+78) |
| 3978813 C→A | rffM/yifK | intergenic (+94/−97) |
| 3982057 C→T | aslB | L359L (CTC→CTT) |
| 3983344 C→T | aslA | V229V (GTG→GTA) |
| 3990407 Δ8 bp | cyaA | coding (1232-1239/2547 nt) |
| 407943 A→G | ykiA | pseudogene (111/342 nt) |
| 4105271 A→G | fieF | A260A (GCA→GCG) |
| 4153541 A→G | argC | D173G (GAC→GGC) |
| 42111 C→A | caiT/fixA | intergenic (−180/−292) |
| 4234068 T→G | yjbE | V47G (GTC→GGC) |
| 4294403 + CG | gltP/yTRUEO | intergenic (+586/+56) |
| 4306572 3434 bp→82 bp | alsC | |
| 4444833 A→G | ytfN | D900G (GAT→GGT) |
| 4503718 G→A | yjhC | V137M (GTT→ATT) |
| 454725 C→T | tig | I123I (ATC→ATT) |
| 4604230 + G | leuP | noncoding (80/87 nt) |
| 4604346 Δ1 bp | leuQ | noncoding (79/87 nt) |
| 507894 T→C | ybaQ/copA | intergenic (+111/+205) |
| 533362 A→G | gcl | T75A (ACT→GCT) |
| 547694 A→G | ylbE_1 | pseudogene (139/252 nt) |
| 547831 + G | ylbE_1 | pseudogene (2/252 nt) |
| 558493 G→T | sfmC | L99L (CTG→CTT) |
| 560913 + G | sfmD | coding (1994/2604 nt) |
| 619171 A→G | fepC | G84G (GGT→GGC) |
| 653396 T→C | dpiA | Y104Y (TAT→TAC) |
| 696062 G→A | glnW/glnU | intergenic (−9/+26) |
| 700027 C→T | nagC | C264Y (TGC→TAC) |
| 700286 + C | nagC | coding (532/1221 nt) |

TABLE VIa-continued

Mutations Identified from Genomic Sequencing

| Mutation Position & Nucleotide change (with reference to SEQ ID NO: 1) | Gene | Protein change |
|---|---|---|
| 700599 + C | nagC | coding (219/1221 nt) |
| 700679 + G | nagC | coding (139/1221 nt) |
| 751964 C→T | ybgD | A19T (GCA→ACA) |
| 760544 C→T | sucA | C872C (TGC→TGT) |
| 844446 C→T | ybiO | P86P (CCG→CCA) |
| 852434 + A | mntR | coding (29/468 nt) |
| 922473 + G | clpS/clpA | intergenic (+17/−14) |
| 961467 C→T | rpsA | M84M (CTG→TTG) |
| 963462 A→G | ihfB/ycaI | intergenic (+127/−81) |

TABLE VIb

Mutations Identified from Genomic Sequencing

| Mutation Position & Nucleotide change | BOP27' (Wild Type) ATCC 700926 | BOP384' Day 0 (see SEQ ID NO: 2) | BOP384G1D' Day 3 (see SEQ ID NO: 3) | BOP384G1H' Day 5 (see SEQ ID NO: 4) | BOP384G1N' Day 8 (see SEQ ID NO: 5) |
|---|---|---|---|---|---|
| 1022011 C→T | | | TRUE | | |
| 111897 G→A | | | | | |
| 1135244 A→G | | | | | TRUE |
| 1137595 A→G | | | | | |
| 1163111 A→G | | | | | TRUE |
| 1247873 G→A | | | | TRUE | |
| 1260197 C→T | | | | | |
| 1274794 T→C | | | | | |
| 1386732 A→G | | | | | |
| 1435247 Δ1 bp | | | | | |
| 1440978 G→A | | | | | |
| 1580390 A→G | | | | TRUE | |
| 1604028 T→C | | | | | |
| 1610530 + C | | | | | TRUE |
| 1679479 T→C | | TRUE | | | |
| 1682336 A→G | | | | | |
| 1729483 G→A | | | | | |
| 1760136 G→A | | | TRUE | | |
| 1866695 G→A | | | | | |
| 1929016 G→A | | | TRUE | | |
| 1950262 G→A | | | | | TRUE |
| 1976527 Δ776 bp | | TRUE | TRUE | TRUE | TRUE |
| 2071288 G→A | | | | | |
| 2085304 + G | | | | | |
| 2098010 T→C | | | | | |
| 2257220 A→G | | | | | |
| 2358479 + C | | | | TRUE | |
| 2405257 G→C | | TRUE | TRUE | TRUE | TRUE |
| 2534334 Δ1 :: IS186 (—) + 6 bP :: Δ1 | | TRUE | TRUE | TRUE | TRUE |
| 2620968 Δ1 bp | | | | | |
| 2662540 T→C | | | | | TRUE |
| 2732557 + C | | | | | |
| 2740321 T→C | | TRUE | TRUE | TRUE | TRUE |
| 2763809 + C | | | | | |
| 2767188 G→A | | | | | |
| 2782127 A→G | | | | | |
| 2809146 + A | | | | | |
| 2824039 T→C | | | | | |
| 2826646 G→A | | | | | TRUE |
| 2844070 G→A | | | | | |

TABLE VIb-continued

Mutations Identified from Genomic Sequencing

| Mutation Position & Nucleotide change | BOP27' (Wild Type) ATCC 700926 | BOP384' Day 0 (see SEQ ID NO: 2) | BOP384G1D' Day 3 (see SEQ ID NO: 3) | BOP384G1H' Day 5 (see SEQ ID NO: 4) | BOP384G1N' Day 8 (see SEQ ID NO: 5) |
|---|---|---|---|---|---|
| 2926442 + T | | | | TRUE | |
| 2927497 G→A | | | | | TRUE |
| 2932138 T→A | | TRUE | TRUE | TRUE | TRUE |
| 2965591 T→C | | | | | |
| 2975919 T→C | | | | | |
| 3114125 C→T | | | | | |
| 3176882 G→A | | | | | |
| 3218853 T→C | | | | | |
| 3246033 G→A | | | | TRUE | |
| 3268091 C→T | | | | | |
| 3268123 C→A | | | | | |
| 3268165 C→T | | | | | |
| 3279141 C→T | | TRUE | TRUE | TRUE | TRUE |
| 3302829 Δ1 bp | | | | | |
| 3315496 A→G | | TRUE | | | |
| 3335733 C→T | | | | TRUE | |
| 34111 + T | | | | | TRUE |
| 3429378 T→C | | | TRUE | | |
| 345189 A→G | | | TRUE | | |
| 3506796 T→C | | | | | |
| 3526004 T→C | | | | | |
| 3548297 T→C | | | | TRUE | |
| 379237 Δ1 bp | | | | | TRUE |
| 379237 Δ2 bp | | | | | |
| 386281 C→T | | | | | |
| 3955730 G→A | | TRUE | | | |
| 3957957 C→T | TRUE | TRUE | TRUE | TRUE | TRUE |
| 3978813 C→A | | | | | |
| 3982057 C→T | | | | | |
| 3983344 C→T | | | | | |
| 3990407 Δ8 bp | | TRUE | TRUE | TRUE | TRUE |
| 407943 A→G | | | | | |
| 4105271 A→G | | | | | |
| 4153541 A→G | | TRUE | 0/47 | | |
| 42111 C→A | | | | | |
| 4234068 T→G | | | | | |
| 4294403 + CG | TRUE | TRUE | TRUE | TRUE | TRUE |
| 4306572 3434 bp→82 bp | | TRUE | TRUE | TRUE | TRUE |
| 4444833 A→G | | | | | |
| 4503718 G→A | | | | | |
| 454725 C→T | | | TRUE | TRUE | |
| 4604230 + G | | | | TRUE | |
| 4604346 Δ1 bp | | | | | |
| 507894 T→C | | TRUE | TRUE | TRUE | TRUE |
| 533362 A→G | | | | TRUE | |
| 547694 A→G | TRUE | TRUE | TRUE | TRUE | TRUE |
| 547831 + G | TRUE | TRUE | TRUE | TRUE | TRUE |
| 558493 G→T | | | | | |
| 560913 + G | | | | | |
| 619171 A→G | | | | | |
| 653396 T→C | | | | | |
| 696062 G→A | | | | | |
| 700027 C→T | | | | | TRUE |
| 700286 + C | | | | TRUE | |
| 700599 + C | | | | | |
| 700679 + G | | | TRUE | | |
| 751964 C→T | | TRUE | | | |
| 760544 C→T | | | | | |
| 844446 C→T | | | | | TRUE |
| 852434 + A | | | | TRUE | |
| 922473 + G | | | TRUE | | |
| 961467 C→T | | | | | |
| 963462 A→G | | | | | |

TABLE VIc

Mutations Identified from Genomic Sequencing

| Mutation Position & Nucleotide change | BOP384G1S' Day 10 (see SEQ ID NO: 6) | BOP384G1X' Day 13 (see SEQ ID NO: 7) | BOP384eG1' (isolate 1) Day 14 (see SEQ ID NO: 8) | BOP384eG1' (isolate 2) Day 14 (see SEQ ID NO: 9) |
|---|---|---|---|---|
| 1022011 C→T | | | | |
| 111897 G→A | | | TRUE | |
| 1135244 A→G | | | | |
| 1137595 A→G | | TRUE | TRUE | TRUE |
| 1163111 A→G | | | | |
| 1247873 G→A | | | | |
| 1260197 C→T | TRUE | | | |
| 1274794 T→C | | TRUE | TRUE | TRUE |
| 1386732 A→G | | | TRUE | |
| 1435247 Δ1 bp | | TRUE | | |
| 1440978 G→A | | TRUE | TRUE | TRUE |
| 1580390 A→G | | | | |
| 1604028 T→C | | TRUE | | |
| 1610530 + C | | | | |
| 1679479 T→C | | | | |
| 1682336 A→G | | TRUE | TRUE | TRUE |
| 1729483 G→A | | TRUE | TRUE | TRUE |
| 1760136 G→A | | | | |
| 1866695 G→A | | | TRUE | |
| 1929016 G→A | | | | |
| 1950262 G→A | TRUE | | | |
| 1976527 Δ776 bp | TRUE | TRUE | TRUE | TRUE |
| 2071288 G→A | | TRUE | TRUE | TRUE |
| 2085304 + G | | TRUE | TRUE | |
| 2098010 T→C | | TRUE | TRUE | TRUE |
| 2257220 A→G | | | TRUE | |
| 2358479 + C | | | | |
| 2405257 G→C | TRUE | TRUE | TRUE | TRUE |
| 2534334 Δ1::IS186 (—) + 6 bp::Δ1 | TRUE | TRUE | TRUE | TRUE |
| 2620968 Δ1 bp | TRUE | | | |
| 2662540 T→C | TRUE | | | |
| 2732557 + C | | TRUE | TRUE | |
| 2740321 T→C | TRUE | TRUE | TRUE | TRUE |
| 2763809 + C | TRUE | | | |
| 2767188 G→A | TRUE | | | |
| 2782127 A→G | | | TRUE | |
| 2809146 + A | | TRUE | TRUE | |
| 2824039 T→C | | | TRUE | |
| 2826646 G→A | TRUE | | | |
| 2844070 G→A | | TRUE | TRUE | TRUE |
| 2926442 + T | | | | |
| 2927497 G→A | TRUE | TRUE | TRUE | TRUE |
| 2932138 T→A | TRUE | TRUE | TRUE | TRUE |
| 2965591 T→C | | | TRUE | |
| 2975919 T→C | | TRUE | TRUE | TRUE |
| 3114125 C→T | TRUE | | | |
| 3176882 G→A | | | TRUE | |
| 3218853 T→C | TRUE | | | |
| 3246033 G→A | | | | |
| 3268091 C→T | TRUE | | | |
| 3268123 C→A | TRUE | | | |
| 3268165 C→T | TRUE | | | |
| 3279141 C→T | TRUE | TRUE | TRUE | TRUE |
| 3302829 Δ1 bp | TRUE | | | |
| 3315496 A→G | | | | |
| 3335733 C→T | | | | |
| 34111 + T | TRUE | TRUE | TRUE | |
| 3429378 T→C | | | | |
| 345189 A→G | | | | |
| 3506796 T→C | | | TRUE | |
| 3526004 T→C | | TRUE | TRUE | TRUE |
| 3548297 T→C | | | | |
| 379237 Δ1 bp | | TRUE | TRUE | |
| 379237 Δ2 bp | TRUE | | | |
| 386281 C→T | | TRUE | | TRUE |
| 3955730 G→A | | | | |
| 3957957 C→T | TRUE | TRUE | TRUE | TRUE |
| 3978813 C→A | | | TRUE | |
| 3982057 C→T | | TRUE | | |

TABLE VIc-continued

Mutations Identified from Genomic Sequencing

| Mutation Position & Nucleotide change | BOP384G1S' Day 10 (see SEQ ID NO: 6) | BOP384G1X' Day 13 (see SEQ ID NO: 7) | BOP384eG1' (isolate 1) Day 14 (see SEQ ID NO: 8) | BOP384eG1' (isolate 2) Day 14 (see SEQ ID NO: 9) |
|---|---|---|---|---|
| 3983344 C→T | TRUE | | | |
| 3990407 Δ8 bp | TRUE | TRUE | TRUE | TRUE |
| 407943 A→G | | TRUE | | |
| 4105271 A→G | | | TRUE | |
| 4153541 A→G | | | | |
| 42111 C→A | | | TRUE | |
| 4234068 T→G | TRUE | | | |
| 4294403 + CG | TRUE | TRUE | TRUE | TRUE |
| 4306572 3434 bp→82 bp | TRUE | TRUE | TRUE | TRUE |
| 4444833 A→G | | TRUE | TRUE | TRUE |
| 4503718 G→A | TRUE | | | |
| 454725 C→T | | | | |
| 4604230 + G | | | | |
| 4604346 Δ1 bp | | TRUE | | |
| 507894 T→C | TRUE | TRUE | TRUE | TRUE |
| 533362 A→G | | | | |
| 547694 A→G | TRUE | TRUE | TRUE | TRUE |
| 547831 + G | TRUE | TRUE | TRUE | TRUE |
| 558493 G→T | | | TRUE | |
| 560913 + G | | TRUE | TRUE | TRUE |
| 619171 A→G | | | TRUE | |
| 653396 T→C | | TRUE | TRUE | TRUE |
| 696062 G→A | | TRUE | | |
| 700027 C→T | | TRUE | TRUE | TRUE |
| 700286 + C | TRUE | | | |
| 700599 + C | | | | |
| 700679 + G | | | | |
| 751964 C→T | | | | |
| 760544 C→T | | TRUE | TRUE | TRUE |
| 844446 C→T | TRUE | | | |
| 852434 + A | | | TRUE | |
| 922473 + G | | | | |
| 961467 C→T | | | | |
| 963462 A→G | | | TRUE | |

General Comments

With respect to the use of substantially any plural and/or singular terms herein, those having skill in the art can translate from the plural to the singular and/or from the singular to the plural as is appropriate to the context and/or application. The various singular/plural permutations may be expressly set forth herein for sake of clarity.

It will be understood by those within the art that, in general, terms used herein, and especially in the appended claims (e.g., bodies of the appended claims) are generally intended as "open" terms (e.g., the term "including" should be interpreted as "including but not limited to," the term "having" should be interpreted as "having at least," the term "includes" should be interpreted as "includes but is not limited to," etc.). It will be further understood by those within the art that if a specific number of an introduced claim recitation is intended, such an intent will be explicitly recited in the claim, and in the absence of such recitation no such intent is present. For example, as an aid to understanding, the following appended claims may contain usage of the introductory phrases "at least one" and "one or more" to introduce claim recitations. However, the use of such phrases should not be construed to imply that the introduction of a claim recitation by the indefinite articles "a" or "an" limits any particular claim containing such introduced claim recitation to embodiments containing only one such recitation, even when the same claim includes the introductory phrases "one or more" or "at least one" and indefinite articles such as "a" or "an" (e.g., "a" and/or "an" should be interpreted to mean "at least one" or "one or more"); the same holds true for the use of definite articles used to introduce claim recitations. In addition, even if a specific number of an introduced claim recitation is explicitly recited, those skilled in the art will recognize that such recitation should be interpreted to mean at least the recited number (e.g., the bare recitation of "two recitations," without other modifiers, means at least two recitations, or two or more recitations). Furthermore, in those instances where a convention analogous to "at least one of A, B, and C, etc." is used, in general such a construction is intended in the sense one having skill in the art would understand the convention (e.g., "a system having at least one of A, B, and C" would include but not be limited to systems that have A alone, B alone, C alone, A and B together, A and C together, B and C together, and/or A, B, and C together, etc.). In those instances where a convention analogous to "at least one of A, B, or C, etc." is used, in general such a construction is intended in the sense one having skill in the art would understand the convention (e.g., "a system having at least one of A, B, or C" would include but not be limited to systems that have A alone, B alone, C alone, A and B together, A and C together, B and C together, and/or A, B, and C together, etc.). It will be further understood by those within the art that virtually any disjunctive word and/or phrase presenting two or more alternative terms, whether in the description, claims, or drawings, should be understood to contemplate the possibilities of including one of the terms, either of the terms, or both terms. For example, the phrase "A or B" will be understood to include the possibilities of "A" or "B" or "A and B."

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, such as in terms of providing a written description, all ranges disclosed herein also encompass any and all possible sub-ranges and combinations of sub-ranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like include the number recited and refer to ranges which can be subsequently broken down into sub-ranges as discussed above. Finally, as will be understood by one skilled in the art, a range includes each individual member. Thus, for example, a group having 1-3 articles refers to groups having 1, 2, or 3 articles. Similarly, a group having 1-5 articles refers to groups having 1, 2, 3, 4, or 5 articles, and so forth.

While various aspects and embodiments have been disclosed herein, other aspects and embodiments will be apparent to those skilled in the art. The various aspects and embodiments disclosed herein are for purposes of illustration and are not intended to be limiting, with the true scope and spirit being indicated by the following claims.

While the present invention has been described in some detail for purposes of clarity and understanding, one skilled in the art will appreciate that various changes in form and detail can be made without departing from the true scope of the invention.

The term "comprising" as used herein is synonymous with "including," "containing," or "characterized by," and is inclusive or open-ended and does not exclude additional, unrecited elements or method steps.

All numbers expressing quantities of ingredients, reaction conditions, and so forth used in the specification are to be understood as being modified in all instances by the term "about." Accordingly, unless indicated to the contrary, the numerical parameters set forth herein are approximations that may vary depending upon the desired properties sought to be obtained. At the very least, and not as an attempt to limit the application of the doctrine of equivalents to the scope of any claims in any application claiming priority to the present application, each numerical parameter should be construed in light of the number of significant digits and ordinary rounding approaches.

The above description discloses several methods and materials of the present invention. This invention is susceptible to modifications in the methods and materials, as well as alterations in the fabrication methods and equipment. Such modifications will become apparent to those skilled in the art from a consideration of this disclosure or practice of the invention disclosed herein. Consequently, it is not intended that this invention be limited to the specific embodiments disclosed herein, but that it cover all modifications and alternatives coming within the true scope and spirit of the invention.

The foregoing description and Examples detail certain embodiments. It will be appreciated, however, that no matter how detailed the foregoing may appear in text, the invention may be practiced in many ways and the invention should be construed in accordance with the appended claims and any equivalents thereof.

REFERENCES

All references discussed herein, including the references below, are incorporated herein by reference in their entirety and are hereby made a part of this specification. To the extent publications and patents or patent applications incorporated by reference contradict the disclosure contained in the specification, the specification is intended to supersede and/or take precedence over any such contradictory material.

Acharya S, Foster P L, Brooks P, Fishel R. 2003. The coordinated functions of the *E. coli* MutS and MutL proteins in mismatch repair. Mol Cell 12(1):233-46.

Alper H, Jin Y S, Moxley J F, Stephanopoulos G. 2005a. Identifying gene targets for the metabolic engineering of lycopene biosynthesis in *Escherichia coli*. Metab Eng 7(3):155-64.

Alper H, Miyaoku K, Stephanopoulos G. 2005b. Construction of lycopene-overproducing *E. coli* strains by combining systematic and combinatorial gene knockout targets. Nat Biotechnol 23(5):612-6.

Bailey J E. 1991. Toward a science of metabolic engineering. Science 252(5013):1668-75.

Becker S A, Feist A M, Mo M L, Hannum G, Palsson B O, Herrgard M J. 2007. Quantitative prediction of cellular metabolism with constraint-based models: The COBRA Toolbox. Nat. Protocols 2(3):727-738.

Burgard A P, Pharkya P, Maranas C D. 2003. Optknock: a bilevel programming framework for identifying gene knockout strategies for microbial strain optimization. Biotechnol Bioeng 84(6):647-57.

Chang D E, Jung H C, Rhee J S, Pan J G. 1999. Homofermentative production of D- or L-lactate in metabolically engineered *Escherichia coli* RR1. Appl Environ Microbiol 65(4):1384-9.

Datsenko K A, Wanner B L. 2000. One-step inactivation of chromosomal genes in *Escherichia coli* K-12 using PCR products. Proc Natl Acad Sci USA. 97(12):6640-5.

Dien B S, Nichols N N, Bothast R J. 2001. Recombinant *Escherichia coli* engineered for production of L-lactic acid from hexose and pentose sugars. J Ind Microbiol Biotechnol 27(4):259-64.

Feist A M, Henry C S, Reed J L, Krummenacker M, Joyce A R, Karp P D, Broadbelt L J, Hatzimanikatis V, Palsson B O. 2007. A genome-scale metabolic reconstruction for *Escherichia coli* K-12 MG1655 that accounts for 1260 ORFs and thermodynamic information. Mol Syst Biol 3(121).

Feist A M, Herrgard M J, Thiele I, Reed J L, Palsson B O. 2008a. Reconstruction of biochemical networks in microbial organisms. Nat Rev Microbiol Accepted.

Feist A M, Palsson B O. 2008. The growing scope of applications of genome-scale metabolic reconstructions using *Escherichia coli*. Nat Biotech 26(6):659-667.

Feist A M, Zielinski D C, Orth J D, Schellenberger J, Herrgard M J, Palsson B O. 2010. Model-driven evaluation of the production potential for growth-coupled products of *Escherichia coli*. Metab Eng. 12(3): 173-186.

Fong S S, Burgard A P, Herring C D, Knight E M, Blattner F R, Maranas C D, Palsson B O. 2005. In silico design and adaptive evolution of *Escherichia coli* for production of lactic acid. Biotechnol Bioeng 91(5):643-8.

Fong S S, Marciniak J Y, Palsson B O. 2003. Description and Interpretation of Adaptive Evolution of *Escherichia coli* K-12 MG1655 Using a Genome-scale in silico Metabolic Model. Journal of Bacteriology 185(21):6400-8.

Fong S S, Palsson B O. 2004. Metabolic gene-deletion strains of *Escherichia coli* evolve to computationally predicted growth phenotypes. Nat Genet. 36(10):1056-58.

Giraud A, Matic I, Tenaillon O, Clara A, Radman M, Fons M, Taddei F. 2001. Costs and benefits of high mutation rates: adaptive evolution of bacteria in the mouse gut. Science 291(5513):2606-8.

Herring C D, Raghunathan A, Honisch C, Patel T, Applebee M K, Joyce A R, Albert T J, Blattner F R, van den Boom D, Cantor C R and others. 2006. Comparative genome sequencing of *Escherichia coli* allows observation of bacterial evolution on a laboratory timescale. Nat Genet. 38(12):1406-1412.

Hofvendahl K, Hahn-Hagerdal B. 2000. Factors affecting the fermentative lactic acid production from renewable resources-1. Enzyme and Microbial Technology 26(2-4):87-107.

Ibarra R U, Edwards J S, Palsson B O. 2002. *Escherichia coli* K-12 undergoes adaptive evolution to achieve in silico predicted optimal growth. Nature 420(6912):186-9.

Lee K H, Park J H, Kim T Y, Kim H U, Lee S Y. 2007. Systems metabolic engineering of *Escherichia coli* for L-threonine production. Mol Syst Biol 3:149.

Lee S J, Lee D Y, Kim T Y, Kim B H, Lee J, Lee S Y. 2005. Metabolic engineering of *Escherichia coli* for enhanced production of succinic acid, based on genome comparison and in silico gene knockout simulation. Appl Environ Microbiol 71(12):7880-7.

Lee S Y, Kim J M, Song H, Lee J W, Kim T Y, Jang Y S. 2008. From genome sequence to integrated bioprocess for succinic acid production by Mannheimia succiniciproducens. Appl Microbiol Biotechnol 79(1):11-22.

Lee S Y, Papoutsakis E T. 1999. Metabolic Engineering: CRC Press.

Neidhardt F C, editor. 1996. *Escherichia coli* and *Salmonella*: cellular and molecular biology. 2nd ed. Washington, D.C.: ASM Press. 2 v. (xx, 2822, lxxvii) p.

Oh Y K, Palsson B O, Park S M, Schilling C H, Mahadevan R. 2007. Genome-scale reconstruction of metabolic network in *bacillus subtilis* based on high-throughput phenotyping and gene essentiality data. J Biol. Chem.

Park J H, Lee K H, Kim T Y, Lee S Y. 2007. Metabolic engineering of *Escherichia coli* for the production of L-valine based on transcriptome analysis and in silico gene knockout simulation. Proc Natl Acad Sci USA 104(19):7797-802.

Park J H, Lee S Y, Kim T Y, Kim H U. 2008. Application of systems biology for bioprocess development. Trends Biotechnol 26(8):404-12.

Patil K R, Rocha I, Forster J, Nielsen J. 2005. Evolutionary programming as a platform for in silico metabolic engineering. BMC Bioinformatics 6:308.

Price N D, Reed J L, Palsson B O. 2004. Genome-scale models of microbial cells: evaluating the consequences of constraints. Nat Rev Microbiol 2(11):886-897.

Reed J L, Patel T R, Chen K H, Joyce A R, Applebee M K, Herring C D, Bui O T, Knight E M, Fong S S, Palsson B O. 2006. Systems approach to refining genome annotation. Proc Natl Acad Sci USA 103(46):17480-4.

Schlensog V, Bock A. 1991. The *Escherichia coli* fdv gene probably encodes mutS and is located at minute 58.8 adjacent to the hyc-hyp gene cluster. J Bacteriol 173(23): 7414-5.

Shaver A C, Dombrowski P G, Sweeney J Y, Treis T, Zappala R M, Sniegowski P D. 2002. Fitness evolution and the rise of mutator alleles in experimental *Escherichia coli* populations. Genetics 162(2):557-66.

Stephanopoulos G, Nielsen J, Aristidou A. 1998. Metabolic Engineering. San Diego Academic Press.

Varma A, Palsson B O. 1994. Stoichiometric flux balance models quantitatively predict growth and metabolic by-product secretion in wild-type *Escherichia coli* W3110. Applied and Environmental Microbiology 60(10):3724-3731.

Wang Q, Chen X, Yang Y, Zhao X. 2006. Genome-scale in silico aided metabolic analysis and flux comparisons of *Escherichia coli* to improve succinate production. Appl Microbiol Biotechnol V73(4):887-894.

Zhou S, Causey T B, Hasona A, Shanmugam K T, Ingram L O. 2003. Production of Optically Pure D-Lactic Acid in Mineral Salts Medium by Metabolically Engineered *Escherichia coli* W3110. Appl. Environ. Microbiol. 69(1): 399-407.

Zhu Y, Eiteman M A, DeWitt K, Altman E. 2007. Homo-lactate fermentation by metabolically engineered *Escherichia coli* strains. Appl Environ Microbiol 73(2):456-64.

SEQUENCE LISTING (9 sequences)

SEQ ID NO: 1 - DNA, 4639675 bp, E. coli (residues 1-1,546,559 of 4,639,675)
agcttttcattctgactgcaacgggcaatatgtctctgtgtggattaaaaaaagagtgtctgatagcagcttctgaactggttacctgccgtgagtaaattaaaattttattgacttaggtcactaaatactttaaccaatataggcatagcgcacagacagataaaaattacagagtacacaacatccatgaaacgcattagcaccaccattaccaccaccatcaccattaccacaggtaacggtgcgggctgacgcgtacaggaaacacagaaaaaagcccgcacctgacagtgcgggctttttttttcgaccaaaggtaacgaggtaacaaccatgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaaatgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaaaatctattcattatctcaatcaggccgggtttgcttttatgcagcccggcttttttatgaagaaattatggagaaaaatgacagggaaaaaggagaaattctcaataaatgcggtaacttagagattaggattgcggagaataacaaccgccgttctcatcgagtaatctccggatatcgacccataacgggcaatgataaaaggagtaacctgtgaaaaagatgcaatctatcgtactcgcactttccctggttctggtcgctcccatggcagcacaggctgcggaaattacgttagtcccgtcagtaaaattacagataggcgatcgtgataatcgtggctattactgggatggaggtcactggcgcgaccacggctggtggaaacaacattatgaatggcgaggcaatcgctggcacctacacggaccgccgccaccgccgcgccaccataagaaagctcctcatgatcatcacggcggtcatggtccaggcaaacatcaccgctaaatgacaaatgccgggtaacaatccggcattcagcgcctgatgcgacgctggcgcgtcttatcaggcctacgttaattctgcaatatattgaatctgcatgcttttgtaggcaggataaggcgttcacgccgcatccggcattgactgcaaacttaacgctgctcgtagcgtttaaacaccagttcgccattgctggaggaatcttcatcaaagaagtaaccttcgctattaaaaccagtcagttgctctggtttggtcagccgattttcaataatgaaacgactcatcagaccgcgtgctttcttagcgtagaagctgatgatcttaaatttgccgttcttctcatcgaggaacaccggcttgataatctcggcattcaatttcttcggcttcaccgatttaaaatactcatctgacgccagattaatcaccacattatcgccttgtgctgcgagcgcctcgttcagcttgttggtgatgatatctccccagaattgatacagatctttccctcgggcattctcaagacggatccccatttccagacgataaggctgcattaaatcgagcgggcggagtacgccatacaagccggaaagcattcgcaaatgctgttgggcaaaatcgaaatcgtcttcgctgaaggtttcggcctgcaagccggtgtagacatcacctttaaacgccagaatcgcctggcgggcattcgccggcgtgaaatctggctgccagtcatgaaagcgagcggcgttgatacccgccagtttgtcgctgatgcgcatcagcgtgctaatctgcggaggcgtcagtttccgcgcctcatggatcaactgctgggaattgtctaacagctccggcagcgtatagcgcgtggtggtcaacgggctttggtaatcaagcgttttcgcaggtgaaataagaatcagcatatccagtccttgcaggaaatttatgccgactttagcaaaaaatgagaatgagttgatcgatagttgtgattactcctgcgaaacatcatcccacgcgtccggagaaagctggcgaccgatatccggataacgcaatggatcaaacaccgggcgcacgccgagtttacgctggcgtagataatcactggcaatggtatgaaccacaggcgagagcagtaaaatggcggtcaaattggtaatagccatgcaggccattatgatatctgccagttgccacatcagcggaaggcttagcaaggtgccgccgatgaccgttgcgaaggtgcagatccgcaaacaccagatcgctttagggttgttcaggcgtaaaaagaagagattgttttcggcataaatgtagttggcaacgatggagctgaaggcaaacagaataaccacaagggtaacaaactcagcaccccaggaacccattagcacccgcatcgccttctggataagctgaataccttccagcggcatgtaggttgtgccgttacccgccagtaatatcagcatggcgcttgccgtacagatgaccagggtgtcgataaaaatgccaatcatctggacaatcccttgcgctgccggatgcggaggccaggacgccgctgccgctgccgcgtttggcgtcgaacccattcccgcctcattggaaaacatactgcgctgaaaaccgttagtaatcgcctggcttaaggtatatcccgccgcgccgcctgccgcttcctgccagccaaaagcactctcaaaaatagaccaaatgacgtggggaagttgcccgatattcattacgcaaattaccaggctggtcagtacccagattatcgccatcaacgggacaaagccctgcatgagccgggcgacgccatgaagaccgcgagtgattgccagcagagtaaagacagcgagaataatgcctgtcaccagcgggggaaaatcaaaagaaaaactcagggcgcgggcaacggcgttcgcttgaactccgctgaaaattatgccataggcgatgagcaaaaagacggcgaacagaacgcccatccagcgcatccccagcccgcgcgccatataccatgccggtccgccacgaaactgcccattgacgtcacgttctttataaagttgtgccagagaacattcggcaaacgaggtcgccatgccgataaacgcggcaacccacatccaaaagacggctccaggtccaccggcggtaatagccagcgcaacgccggccaggttgccgctacccacgcgcgccgcaagactggtacacaatgactgaaatgaggttaaaccgcctggctgtggatgaatgctatttttaagacttttgccaaactggcggatgtagcgaaactgcacaaatccggtgcgaaaagtgaaccaacaacctgcgccgaagagcaggtaaatcattaccgatccccaaaggacgctgttaatgaaggagaaaaaatctggcatgcatatccctcttattgccggtcgcgatgactttcctgtgtaaacgttaccaattgtttaagaagtatatacgctacgaggtacttgataacttctgcgtagcatacatgaggttttgtataaaaatggcgggcgatatcaacgcagtgtcagaaatccgaaacagtctcgcctggcgataaccgtcttgtcggcggttgcgctgacgttgcgtcgtgatatcatcagggcagaccggttacatccccctaacaagctgtttaaagagaaatactatcatgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggcagtaaatattggtctggaaatcctgaaactggttccgggccgtatctcaactgaagttgatgcgcgtctttcctatgacaccgaagcgtcaattgcgaaagcaaaacgcctgatcaaactctacaacgatgctggtattagcaacgatcgtattctgatcaaactggcttctacctggcagggtatccgtgctgcagaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcacggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacaccggcgaagtgaaagcgcgtccggcgcgtatcactgagtccgagttcctgtggcagcacaaccaggatccaatggcagtagataaactggcggaaggtatccgtaagtttgctattgaccaggaaaaactggaaaaaatgatcggcgatctgctgtaatcattcttagcgtgaccgggaagtcggtcacgctacctcttctgaagcctgtctgtcactcccttcgcagtgtatcattctgtttaacgagactgtttaaacggaaaaatcttgatgaatactttacgtattggcttagtttccatctctgatcgcgcatccagcggcgtttatcaggataaaggcatccctgcgctggaagaatggctgacatcggcgctaaccacgccgtttgaactggaaacccgcttaatccccgatgagcaggcgatcatcgagcaaacgttgtgtgagctggtggatgaaatgagttgccatctggtgctcaccacgggcggaactggcccggcgcgtcgtgacgtaacgcccgatgcgacgctggcagtagcggaccgcgagatgcctggctttggtgaacagatgcgccagatcagcctgcattttgtaccaactgcgatcctttcgcgtcaggtgggcgtgattcgcaaacaggcgctgatccttaacttacccggtcagccgaagtctattaaagagacgctggaaggtgtgaaggacgctgagggtaacgttgtggtacacggtatttttgccagcgtaccgtactgcattcagttgctggaagggccatacgttgaaacggcaccggaagtggttgcagcattcagaccgaagagtgcaagacgcgacgttagcgaataaaaaaatccccccgagcggggggatctcaaaacaattagtgggattcaccaatcggcagaacggtgcgaccaaactgctcgttcagtacttcacccatcgccagatagattgcgctggcaccgcagatcagcccaatccagccggcaaagtggatgattgcggcgttaccggcaatgttaccgatcgccagcagggcaaacagcacggtcaggctaaagaaaacgaattgcagaacgcgtgcgcctttcagcgtgccgaagaacataaacagcgtaaatacgccccacagacccaggtagacaccaaggaactgtgcatttggcgcatcggtcagacccagtttcggcatcagcagaatcgcaaccagcgtcagccagaaagaaccgtaagaggtgaatgcggttaaaccgaaagtgttgccttttttgtactccagcagaccagcaaaaatttgcgcgatgccgccgtagaaaatgcccatggcaagaataataccgtccagagcgaaataacccacgttgtgcaggttaagcagaatggtggtcatgccgaagcccatcaggcccagcggtgccggattagccaacttagtgttgcccataattcctcaaaaatcatcatcgaatgaatggtgaaataatttccctgaataactgtagtgttttcagggcgcggcataataatcagccagtggggcagtgtctacgatcttttgaggggaaaatgaaaattttccccggtttccggtatcagacctgagtggcgctaaccatccggcgcaggcaggcgatttgcagtacggctggaatcgtcacgcgataggcgctgccgctgaccgctttaaccccatttagtgccgcacctacagggcctcccagccccgcgccgcgcagcaaaccatgcccaagtacgctcattgctgcgtgggtgcgtaaaatgcgggtcagttggctggaaagcaaatgcgacacaccttttgccaataatttgtctttcatcagcagcggcagcagctcttccagctcattcaccctggcatcgaccgcgtgcagaaactcctgcttatgttcctcgtccattttcttccaggtattacgcagaaattgttccagtaactgttgctcaatttcaaacgtagacatctctttgtcggctttcagcttcaatcgctttgaaacatcgagcaaaatggcccgatacaatttaccgtgtccgcgcagtttgttggcgatactatcgccaccaaaatgctgtaattctccggcaatcagctgccagttgcggcgatgttgctcgggatgcccttccatcgatttaaacagttcgttgcgcatcagtacgctggagaggcgagttttgcctttttcattatgggtgagcaatcgggcgaaatttgccaactgttcctcactacaatgctgaagaaaatccagatctgaatcattcaggtaattaacattcattttttgtggcttctatattctggcgttagtcgtcgccgataattttcagcgtggccatatccgatgagttcaccgtatgacccgaaaaggtgatttttgagacgcagcgtttattgtcgttatcgctgttaatgttgatccagtcagtggtttgcccttcttttatttctgaaggaatattcaggctctgactggcgctacgggcggctttgaaataaaccgatgcaccgcttaactgtaaatcgccatggtcggcagagagttgtatgcgtttcacaatgcgacaaacaggaagtttcagcgccagatcgttggtttcgttacgcggcattgcaatggcgccgaggagtttatggtcgtttgcctgcgccgtgcagcacagcatcaggctaatcgccaggctggcggaaatcgtaaaaacggatttcataaggattctcttagtgggaagaggtagggggatgaatacccactagtttactgctgataaagagaagattcaggcacgtaatcttttctttttattacaattttttgatgaatgccttggctgcgattcattctttatatgaataaaattgctgtcaattttacgtcttgtcctgccatatcgcgaaatttctgcgcaaaagcacaaaaaatttttgcatctcccccttgatgacgtggtttacgaccccatttagtagtcaaccgcagtgagtgagtctgcaaaaaaatgaaattgggcagttgaaaccagacgtttcgcccctattacagactcacaaccacatgatgaccgaatatatagtggagacgtttagatgggtaaaataattggtatcgacctgggtactaccaactcttgtgtagcgattatggatggcaccactcctcgcgtgctggagaacgccgaaggcgatcgcaccacgccttctatcattgcctatacccaggatggtgaaactctagttggtcagccggctaaacgtcaggcagtgacgaacccgcaaaacactctgtttgcgattaaacgcctgattggtcgccgcttccaggacgaagaagtacagcgtgatgtttccatcatgccgttcaaaattattgctgctgataacggcgacgcatgggtcgaagttaaaggccagaaaatggcaccgccgcagatttctgctgaagtgctgaaaaaaatgaagaaaaccgctgaagattacctgggtgaaccggtaactgaagctgttatcaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggcactggcaaccgtactatcgcggtttatgacctgggtggtggtactttcgatatttctattatcgaaatcgacgaagttgacggcgaaaaaaccttcgaagttctggcaaccaacggtgatacccacctggggggtgaagacttcgacagccgtctgatcaactatctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccatacatcactgcagacgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgagttctttggtaaagagccgcgtaaagacgttaacccggacgaagctgtagcaatcggtgctgctgttcagggtggtgttctgactggtgacgtaaaagacgtactgctgctggacgttaccccgctgtctctgggtatcgaaaccatgggcggtgtgatgacgacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctagatggtatcaacccggcaccgcgcggcatgccgcagatcgaagttaccttcgatatcgatgctgacggtatcctgcacgtttccgcgaaagataaaaacagcggtaaagagcagaagatcaccatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcgctgactgcactggaaactgctctgaaaggtgaagacaaagccgctatcgaagcgaaaatgcaggaactggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataatcgccctataaacgggtaattatactgacacgggcgaaggggaatttcctctccgcccgtgcattcatctaggggcaatttaaaaaagatggctaagcaagattattacgagattttaggcgtttccaaaacagcggaagagcgtgaaatcagaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggtggcatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacttgtccgacctgtcatggttctggtcaggtgcagatgcgccagggattcttcgctgtacagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggcgagcatggcgcaccggcaggcgatctgtacgttcaggttcaggttaaacagcacccgattttcgagcgtgaaggcaacaacctgtattgcgaagtcccgatcaacttcgctatggcggcgctgggtggcgaaatcgaagtaccgacccttgatggtcgcgtcaaactgaaagtgcctggcgaaacccagaccggtaagctattccgtatgcgcggtaaaggcgtcaagtctgtccgcggtggcgcacagggtgatttgctgtgccgcgttgtcgtcgaaacaccggtaggcctgaacgaaaggcagaaacagctgctgcaagagctgcaagaaagcttcggtggcccaaccggcgagcacaacagcccgcgctcaaagagcttctttgatggtgtgaagaagttttttgacgacctgacccgctaacctccccaaaagcctgcccgtgggcaggcctgggtaaaaatagggtgcgttgaagatatgcgagcacctgtaaagtggcggggatcactcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggatcactccccgccgttgctcttactcggattcgtaagccgtgaaaacagcaacctccgtctggccagttcggatgtgaacctcacagaggtcttttctcgttaccagcgccgccactacggcggtgatacagatgacgatcagggcgacaatcatcgccttatgctgcttcattgctctcttctccttgaccttacggtcagtaagaggcactctacatgtgttcagcatataggaggcctcgggttgatggtaaaatatcactcggggcttttctctatctgccgttcagctaatgcctgagacagacagcctcaagcacccgccgctattatatcgctctctttaacccattttgttttatcgattctaatcctgaagacgcctcgcatttttgtggcgtaattttttaatgatttaattatttaactttaatttatctcttcatcgcaattattgacgacaagctggattatttttgaaatattggcctaacaagcatcgccgactgacaacaaattaattattacttttcctaattaatccctcaggaatcctcaccttaagctatgattatctaggcttagggtcactcgtgagcgcttacagccgtcaaaaacgcatctcaccgctgatggcgcaaattcttcaatagctcgtaaaaaacgaattattcctacactataatctgattttaacgatgattcgtgcggggtaaaatagtaaaaacgatctattcacctgaaagagaaataaaaagtgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttgacaggacggtttaccggggagccataaacggctcccttttcattgttatcagggagagaaatgagcatgtctcatatcaattacaaccacttgtattacttctggcatgtctataaagaaggttccgtggttggcgcagcggaggcgctttatttaactccacaaaccattaccggacagattcgagcgctggaagagcgcctgcaaggcaaattatttaaacgcaagggacgtggtctcgaacccagcgagctgggagaactggtctatcgctatgccgataaaatgttcaccttaagccaggaaatgctggatattgtgaactatcgcaaagaatccaatttattgtttgacgttggcgtggctgatgcactttccaaacgcctggtcagtagcgtacttaacgccgcagtggtagaaggcgagcccattcatcttcgctgcttcgaatccacccacgaaatgctgctggagcaattaagtcagcataaactggatatgatcatttctgactgtccgatagactctacgcagcaggaaggcctgttctccgtgagaattggcgaatgtggcgtgagtttctggtgtacaaatccaccaccagaaaaaccgttcccggcttgtctggaagaacggcgacttttgattcctgggcgacgttcaatgttagggcgcaaattgcttaactggtttaactcccagggattaaacgtagaaatcctcggcgagtttgatgatgccgctttgatgaaagcttttggtgcgatgcacaatgcaatcttcgttgccccaacgctttatgcatatgacttttatgccgataaaactgtcgtagaaattggtcgcgtcgagaatgtgatggaagagtaccatgctatttttgctgagcggatgattcagcacccggcggtacagcgaatctgcaatacggattattctgcgctttttagtccagcggtgcgttaatcggcagctcccccaaagttaaggtgggggagatagattagttgtacattaccacgattttgactcggctcattatttgcccgcttgagacattgtttccatatgtacgcgggcgaataaatagaggaatctgattacttccttcatggggatgctgaaaagagtagtaattgctggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacctacctcaatgtgtatcacaatatccatattctttgtgggggagtctggagattgagtagatattcttgttcagaatgtatcagccgatggttctacgattcttaagccacgaagagttcagatagtacaacggcatgtctcttttgactatctggcaaccggcagtgtgttctctcacgcatcacaaaagcagcaggcataaaaaaacccgcttgcgcgggctttttcacaaagcttcagcaaattggcgattaagccagtttgttgatctgtgcagtcaggttagccttatgacgtgcagctttgtttttgtggatcagacctttagcagcctgacggtccacgatcggttgcatttcgttaaatgctttctgtgcagcagctttgtcgccagcttcgatagctgcgtatactttcttgatgaaagtacgcatcatagagcgacggcttgcgttgtgcttacgagccttttcagactgaatggcgcgcttcttagctgatttgatattagccaaggtccaactcccaaatgtgttctatatggacaattcaaaggccgaggaatatgcccttttagccttcttttgtcaatggatttgtgcaaataagcgccgttaatgtgccggcactcgttacgtagtgatggcgcaggattctaccagcttgcggggtgtgaatacagcttttccgcgataaaaattgcagcaggcggtcagtttcttcccgtgatttgcgccatggcaatgaaaagccacttctttctgatttcggtactcaatcgccggttaaccttgaccgctgtacaaggtatactcggacgattttcactgttttgagccagacatgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctaccgataaagccccggcaagactgacccggctgcgggaaaaactgcgttaccttgcagagtgtggcgttgattacgtgctgtgcgtgcgtttcgacaggcgtttcgcggcgttaaccgcgcaaaatttcatcagcgatcttctggtgaagcatttgcgcgtaaaatttcttgccgtaggtgatgatttccgctttggcgctggtcgtgaaggcgatttcttgttattacagaaagctggcatggaatacggcttcgatatcaccagtacgcaaactttttgcgaaggtggcgtgcgcatcagcagcaccgccgtgcgtcaggcccttgcggatgacaatctggctctggcagagagtttactggggcacccgtttgccatctccgggcgtgtagtccacggtgatgaattagggcgcactataggtttcccgacggcgaatgtaccgctgcgccgtcaggtttccccggtgaaaggggtttatgcggtagaagtgctgggcctcggtgaaaagccgttacccggcgtggcaaacatcggaacacgcccaacggttgccggtattcgccagcagctggaagtgcatttgttagatgttgcaatggacctttacggtcgccatatacaagtagtgctgcgtaaaaaaatacgcaatgagcagcgatttgcgtcgctggacgaactgaaagcgcagattgcgcgtgatgaattaaccgcccgcgaattttttgggctaacaaaaccggcttaagcctgttatgtaatcaaaccgaaatacggaaccgagaatctgatgagtgactataaatcaaccctgaatttgccggaaacagggttcccgatgcgtggcgatctcgccaagcgcgaacccggaatgctggcgcgttggactgatgatgatctgtacggcatcatccgtgcggctaaaaaaggcaaaaaaaccttcattctgcatgatggccctccttatgcgaatggcagcattcatattggtcactcggttaacaagattctgaaagacattatcgtgaagtccaaagggctttccggttatgactcgccgtatgtgcctggctgggactgccacggtctgccgatcgagctgaaagtcgagcaagaatacggtaagccgggtgagaaattcaccgccgccgagttccgcgccaagtgccgcgaatacgcggcgacccaggttgacggtcaacgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccagttcactggtgcgttgactgccgttctgcgctggcggaagcggaagttgagtattacgacaaaacttctccgtccatcgacgttgctttccaggcagtcgatcaggatgcactgaaagcaaaatttgccgtaagcaacgttaacggcccaatctcgctggtaatctggaccaccacgccgtggactctgcctgccaaccgcgcaatctctattgcaccagatttcgactatgcgctggtgcagatcgacggtcaggccgtgattctggcgaaagatctggttgaaagcgtaatgcagcgtatcggcgtgaccgattacaccattctcggcacggtaaaaggtgcggagcttgagctgctgcgctttacccatccgtttatgggcttcgacgttccggcaatcctcggcgatcacgttaccctggatgccggtaccggtgccgttcacaccgcgcctggccacggcccggacgactatgtgatcggtcagaaatacggcctggaaaccgctaacccggttggcccggacggcacttatctgccgggcacttatccgacgctggatggcgtgaacgtcttcaaagcgaacgacatcgtcgttgcgctgctgcaggaaaaaggcgcgctgctgcacgttgagaaaatgcagcacagctatccgtgctgctggcgtcacaaaacgccgatcatcttccgcgcgacgccgcagtggttcgtcagcatggatcagaaaggtctgcgtgcgcagtcactgaaagagatcaaaggcgtgcagtggatcccggactggggccaggcgcgtatcgagtcgatggttgctaaccgtcctgactggtgtatctcccgtcagcgcacctggggtgtaccgatgtcactgttcgtgcacaaagacacggaagagctgcatccgcgtacccttgaactgatggaagaagtggcaaaacgcgttgaagtcgatggcatccaggcgtggtgggatctcgatgcgaaagagatcctcggcgacgaagctgatcagtacgtgaaagtgccggacacattggatgtatggtttgactccggatctacccactcttctgttgttgacgtgcgtccggaatttgccggtcacgcagcggacatgtatctggaaggttctgaccaacaccgcggctggttcatgtcttccctaatgatctccaccgcgatgaagggtaaagcgccgtatcgtcaggtactgacccacggctttaccgtggatggtcagggccgcaagatgtctaaatccatcggcaataccgtttcgccgcaggatgtgatgaacaaactgggcgcggatattctgcgtctgtgggtggcatcaaccgactacaccggtgaaatggccgtttctgacgagatcctgaaacgtgctgccgatagctatcgtcgtatccgtaacaccgcgcgcttcctgctggcaaacctgaacggttttgatccagcaaaagatatggtgaaaccggaagagatggtggtactggatcgctgggccgtaggttgtgcgaaagcggcacaggaagacatcctcaaggcgtacgaagcatacgatttccacgaagtggtacagcgtctgatgcgcttctgctccgttgagatgggttccttctacctcgacatcatcaaagaccgtcagtacaccgccaaagcggacagtgtggcgcgtcgtagctgccagactgcgctatatcacatcgcagaagcgctggtgcgctggatggcaccaatcctctccttcaccgctgatgaagtgtggggctacctgccgggcgaacgtgaaaaatacgtcttcaccggtgagtggtacgaaggcctgtttggcctggcagacagtgaagcgatgaacgatgcgttctgggacgagctgttgaaagtgcgtggcgaagtgaacaaagtcattgagcaagcgcgtgccgacaagaaagtgggtggctcgctggaagcggcagtaaccttgtatgcagaaccggaactgtcggcgaaactgaccgcgctgggcgatgaattacgatttgtcctgttgacctccggcgctaccgttgcagactataacgacgcacctgctgatgctcagcagagcgaagtactcaaagggctgaaagtcgcgttgagtaaagccgaaggtgagaagtgcccacgctgctggcactacacccaggatgtcggcaaggtggcggaacacgcagaaatctgcggccgctgtgtcagcaacgtcgccggtgacggtgaaaaacgtaagtttgcctgatgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcggcgtttagtttccttgccgatagcggcggctggcagcgttggttctttgccggtattgcgattggtattagcgtgatcctggcagtgatgatgtatcgctcgaaggccacgcagaagctaaacaatatcgcttacgcgctgattattggcggcgcgctgggcaacctgttcgaccgcctgtggcacggcttcgttgtcgatatgatcgacttctacgtcggcgactggcacttcgccaccttcaaccttgccgatactgccatctgtgtcggtgcggcactgattgtgctggaaggttttttgccttctagagcgaaaaaacaataataaaccctgccggatgcgatgctgacgcatcttatccggcctacagattgctgcgaaatcgtaggccggataaggcgtttacgccgcatccggcaaaaatccttaaatataagagcaaacctgcatgtctgaatctgtacagagcaatagcgccgtcctggtgcacttcacgctaaaactcgacgatggcaccaccgccgagtctacccgcaacaacggtaaaccggcgctgttccgcctgggtgatgcttctctttctgaagggctggagcaacacctgttggggctgaaagtgggcgataaaaccaccttctcgttggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaacatgcagatcctgttggccaacccgcgtggtttttgtgccggggtagaccgcgctatcagcattgttgaaaacgcgctggccatttacggcgcaccgatatatgtccgtcacgaagtggtacataaccgctatgtggtcgatagcttgcgtgagcgtggggctatctttattgagcagattagcgaagtaccggacggcgcgatcctgattttctccgcacacggtgtttctcaggcggtacgtaacgaagcaaaaagtcgcgatttgacggtgtttgatgccacctgtccgctggtgaccaaagtgcatatggaagtcgcccgcgccagtcgccgtggcgaagaatctattctcatcggtcacgccgggcacccggaagtggaagggacaatgggccagtacagtaacccggaagggggaatgtatctggtcgaatcgccggacgatgtgtggaaactgacggtcaaaaacgaagagaagctctcctttatgacccagaccacgctgtcggtggatgacacgtctgatgtgatcgacgcgctgcgtaaacgcttcccgaaaattgtcggtccgcgcaaagatgacatctgctacgccacgactaaccgtcaggaagcggtacgcgccctggcagaacaggcggaagttgtgttggtggtcggttcgaaaaactcctccaactccaaccgtctggcggagctggcccagcgtatgggcaaacgcgcgtttttgattgacgatgcgaaagacatccaggaagagtgggtgaaagaggttaaatgcgtcggcgtgactgcgggcgcatcggctccggatattctggtgcagaatgtggtggcacgtttgcagcagctgggcggtggtgaagccattccgctggaaggccgtgaagaaaacattgttttcgaagtgccgaaagagctgcgtgtcgatattcgtgaagtcgattaagtcattagcagcctaagttatgcgaaaatgccggtcttgttaccggcattttttatggagaaaacatgcgtttacctatcttcctcgatactgaccccggcattgacgatgccgtcgccattgccgccgcgatttttgcacccgaactcgacctgcaactgatgaccaccgtcgcgggtaatgtctcggttgagaaaactacccgcaatgccctgcaactgctgcatttctggaatgcggagattccgctcgcccaaggggccgctgtgccactggtacgcgcaccgcgtgatgcggcatctgtgcacggcgaatcgggaatggctggctacgactttgttgagcacaaccgaaagccgctcgggataccggcgtttctggcgattcgggatgccctgatgcgtgcaccagagcctgttaccctggtggccatcggcccgttaaccaatattgcgctgttactttcacaatgcccggaatgcaagccgtatattcgccgtctggtgatcatgggtggttctgccggacgcggcaactgtacgccaaacgccgagtttaatattgctgccgatccagaagctgctgcctgtgtcttccgcagtggtattgaaatcgtcatgtgcggtttggatgtcaccaatcaggcaatattaactcctgactatctctctacactgccgcagttaaaccgtaccgggaaaatgcttcacgccctgtttagccactaccgtagcggcagtatgcaaagcggcttgcgaatgcacgatctctgcgccatcgcctggctggtgcgcccggacctgttcactctcaaaccctgttttgtggcagtggaaactcagggcgaatttacctcaggcacgacggtggttgatatcgacggttgcctgggcaagccagccaatgtacaggtggcattggatctggatgtgaaaggcttccagcagtgggtggctgaggtgctggctctggcgtcgtaacctgtcacatgttattggcatgcagtcattcatcgactcatgcctttcactgatatccctccctgtttatcattaatttctaattatcagcgtttttggctggcggcgtagcgatgcgctggttactctgaaaacggtctatgcaaattaacaaaagagaatagctatgcatgatgcaaacatccgcgttgccatcgcgggagccggggggcgtatgggccgccagttgattcaggcggcgctggcattagagggcgtgcagttgggcgctgcgctggagcgtgaaggatcttctttactgggcagcgacgccggtgagctggccggagccgggaaaacaggcgttaccgtgcaaagcagcctcgatgcggtaaaagatgattttgatgtgtttatcgattttacccgtccggaaggtacgctgaaccatctcgctttttgtcgccagcatggcaaagggatggtgatcggcactacggggtttgacgaagccggtaaacaagcaattcgtgacgccgctgccgatattgcgattgtctttgctgccaattttagcgttggcgttaacgtcatgcttaagctgctggagaaagcagccaaagtgatgggtgactacaccgatatcgaaattattgaagcacatcatagacataaagttgatgcgccgtcaggcaccgcactggcaatgggagaggcgatcgcccacgcccttgataaagatctgaaagattgcgcggtctacagtcgtgaaggccacaccggtgaacgtgtgcctggcaccattggttttgccaccgtgcgtgcaggtgacatcgttggtgaacataccgcgatgtttgccgatattggcgagcgtctggagatcacccataaggcgtccagccgtatgacatttgctaacggcgcggtaagatcggctttgtggttgagtggtaaggaaagcggtctttttgatatgcgagatgtacttgatctcaataatttgtaaccacaaaatatttgttatggtgcaaaaataacacatttaatttattgattataaagggctttaatttttggcccttttatttttggtgttatgtttttaaattgtctataagtgccaaaaattacatgttttgtcttctgtttttgttgttttaatgtaaattttgaccatttggtccacttttttctgctcgtttttatttcatgcaatcttcttgctgcgcaagcgttttccagaacaggttagatgatctttttgtcgcttaatgcctgtaaaacatgcatgagccacaaaataatataaaaaatcccgccattaagttgacttttagcgcccatatctccagaatgccgccgtttgccagaaattcgtcggtaagcagatttgcattgatttacgtcatcattgtgaattaatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcaccaatgacgccgatgaagaatcttctcaggtacatgcacaaggtctggtgattcgcgacctgccgctgattgccagcaacttccgtaataccgaagacctctcttcttacctgaaacgccataacatcgtggcgattgccgatatcgatacccgtaagctgacgcgtttactgcgcgagaaaggcgcacagaatggctgcattatcgcgggcgataacccggatgcggcgctggcgttagaaaaagcccgcgcgttcccaggtctgaatggcatggatctggcaaaagaagtgaccaccgcagaagcctatagctggacacaagggagctggacgttgaccggtggcctgccagaagcgaaaaaagaagacgagctgccgttccacgtcgtggcttatgattttggtgccaagcgcaacatcctgcggatgctggtggatagaggctgtcgcctgaccatcgttccggcgcaaacttctgcggaagatgtgctgaaaatgaatccagacggcatcttcctctccaacggtcctggcgacccggccccgtgcgattacgccattaccgccatccagaaattcctcgaaaccgatattccggtattcggcatctgtctcggtcatcagctgctggcgctggcgagcggtgcgaagactgtcaaaatgaaatttggtcaccacggcggcaaccatccggttaaagatgtggagaaaaacgtggtaatgatcaccgcccagaaccacggttttgcggtggacgaagcaacattacctgcaaacctgcgtgtcacgcataaatccctgttcgacggtacgttacagggcattcatcgcaccgataaaccggcattcagcttccaggggcaccctgaagccagccctggtccacacgacgccgcgccgttgttcgaccactttatcgagttaattgagcagtaccgtaaaaccgctaagtaatcaggagtaaaagagccatgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctggtgaactccaacccggcgaccatcatgaccgacccggaaatggctgatgcaacctacatcgagccgattcactgggaagttgtacgcaagattattgaaaaagagcgcccggacgcggtgctgccaacgatgggcggtcagacggcgctgaactgcgcgctggagctggaacgtcagggcgtgttggaagagttcggtgtcaccatgattggtgccactgccgatgcgattgataaagcagaagaccgccgtcgtttcgacgtagcgatgaagaaaattggtctggaaaccgcgcgttccggtatcgcacacacgatggaagaagcgctggcggttgccgctgacgtgggcttcccgtgcattattcgcccatcctttaccatgggcggtagcggcggcggtatcgcttataaccgtgaagagtttgaagaaatttgcgcccgcggtctggatctctctccgaccaaagagttgctgattgatgagtcgctgatcggctggaaagagtacgagatggaagtggtgcgtgataaaaacgacaactgcatcatcgtctgctctatcgaaaacttcgatgcgatgggcatccacaccggtgactccatcactgtcgcgccagcccaaacgctgaccgacaaagaatatcaaatcatgcgtaacgcctcgatggcggtgctgcgtgaaatcggcgttgaaaccggtggttccaacgttcagtttgcggtgaacccgaaaaacggtcgtctgattgttatcgaaatgaacccacgcgtgtcccgttcttcggcgctggcgtcgaaagcgaccggtttcccgattgctaaagtggcggcgaaactggcggtgggttacaccctcgacgaactgatgaacgacatcactggcggacgtactccggcctccttcgagccgtccatcgactatgtggttactaaaattcctcgcttcaacttcgaaaaattcgccggtgctaacgaccgtctgaccactcagatgaaatcggttggcgaagtgatggcgattggtcgcacgcagcaggaatccctgcaaaaagcgctgcgcggcctggaagtcggtgcgactggattcgacccgaaagtgagcctggatgacccggaagcgttaaccaaaatccgtcgcgaactgaaagacgcaggcgcagatcgtatctggtacatcgccgatgcgttccgtgcgggcctgtctgtggacggcgtcttcaacctgaccaacattgaccgctggttcctggtacagattgaagagctggtgcgtctggaagagaaagtggcggaagtgggcatcactggcctgaacgctgacttcctgcgccagctgaaacgcaaaggctttgccgatgcgcgcttggcaaaactggcgggcgtacgcgaagcggaaatccgtaagctgcgtgaccagtatgacctgcacccggtttataagcgcgtggatacctgtgcggcagagttcgccaccgacaccgcttacatgtactccacttatgaagaagagtgcgaagcgaatccgtctaccgaccgtgaaaaaatcatggtgcttggcggcggcccgaaccgtatcggtcagggtatcgaattcgactactgttgcgtacacgcctcgctggcgctgcgcgaagacggttacgaaaccattatggttaactgtaacccggaaaccgtctccaccgactacgacacttccgaccgcctctacttcgagccggtaactctggaagatgtgctggaaatcgtgcgtatcgagaagccgaaaggcgttatcgtccagtacggcggtcagaccccgctgaaactggcgcgcgcgctggaagctgctggcgtaccggttatcggcaccagcccggatgctatcgaccgtgcagaagaccgtgaacgcttccagcatgcggttgagcgtctgaaactgaaacaaccggcgaacgccaccgttaccgctattgaaatggcggtagagaaggcgaaagagattggctacccgctggtggtacgtccgtcttacgttctcggcggtcgggcgatggaaatcgtctatgacgaagctgacctgcgtcgctacttccagacggcggtcagcgtgtctaacgatgcgccagtgttgctggaccacttcctcgatgacgcggtagaagttgacgtggatgccatctgcgacggcgaaatggtgctgattggcggcatcatggagcatattgagcaggcgggcgtgcactccggtgactccgcatgttctctgccagcctacaccttaagtcaggaaattcaggatgtgatgcgccagcaggtgcagaaactggccttcgaattgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgcgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtcatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgacccacggcacggcgattgtgctgggcgaagcaggtatcaacccgcgtctggtaaacaaggtgcatgaaggccgtccgcacattcaggaccgtatcaagaatggcgaatatacctacatcatcaacaccacctcaggccgtcgtgcgattgaagactcccgcgtgattcgtcgcagtgcgctgcaatataaagtgcattacgacaccaccctgaacggcggctttgccaccgcgatggcgctgaatgccgatgcgactgaaaaagtaatttcggtgcaggaaatgcacgcacagatcaaataatagcgtgtcatggcagatatttttcatccgctaatttgatcgaataactaatacggttctctgatgaggaccgtttttttttgcccattaagtaaatcttttggggaatcgatatttttgatgacataagcaggatttagctcacacttatcgacggtgaagttgcatactatcgatatatccacaattttaatatggccttgtttaattgcttcaaaacgagtcatagccagacttttaatttgtgaaactggagttcgtatgtgtgaaggatatgttgaaaaaccactctacttgttaatcgccgaatggatgatggctgaaaatcggtgggtgatagcaagagagatctctattcatttcgatattgaacacagcaaggcggttaataccctgacttatattctgtcggaagtcacagaaataagctgcgaagttaagatgatccctaataagctggaagggcggggatgccagtgtcagcgactggttaaagtggtcgatatcgatgagcaaatttacgcgcgcctgcgcaataacagtcgggaaaaattagtcggtgtaagaaagacgccgcgtattcctgccgttccgctcacggaacttaaccgcgagcagaagtggcagatgatgttgtcaaagagtatgcgtcgttaattttatctcgttgataccgggcgtcctgcttgccagatgcgatgttgtagcatcttatccagcaaccaggtcgcatccggcaagatcaccgtttaggcgtcacatccgtcgtcccctgcaaacgggggcgattttcctccatttgcctcagtggctgcgtttcatgtaacgatacatgacagcgcccgacaagatcctgatactctttggtattcaaccgtttccagtgtaactcgtcgtcactaacattgcgtacagcgcgggctggcgtacccatcaacaactggcgtttctcgccgcgaaagcccgctttgacaaagctcatggcggcaacaatgctctcttcgccaatgaccgcgccatccataatcacgctgttcatcccgaccaatgcatcgcgaccaatcaaacaaccatgcaggatcgctccgtgcccgatatggccgttttccccaacgatagtgtcagtgtcgcagtagccatgcataatgcagccatcctgaatattggctcccgcttgcacgatcaaccgcccgtagtcaccacgcagtgaggcgagtgggccgatgtagacaccggctcccacaatcacatcgccaatcaagacggcactgggatggacaaacgccgtcgggtgaaccaccggaattaacccctcaaaggcgtaatagctcacggttgttaacgtcctttccacaccggatcgcgcttctcggcaaacgccagcggcccttcaatggcatcttccgaatgcagaaccgatggatagtgtttcaacacgccgctgcgaatatagcgatacgcttcttctaccggcatttcgctggtggtgcggtagatctctttcagcgccgcaatcgccagcggggcgctgttaaccagctgctgagccagttcgcgggcgttatccatcagttccgcctggctaaccacgcggttgactatcccccaacgcagcgcctcttctgcgcccattcgtctgccggtcatcaccatttcattgacgatggcaggcggcaggatcttcggcagacgcagcacaccgccgctgtcaggaacgatgcccagtttggcttccggcagggcgaagctggcgttatcggcacaaacaataaaatctgccgccagcgccagttcaaagccgccgccaaaggcatagccgttcacagctgcgataaccggtttgtcgagattgaaaatttcggttaatcccgcaaaaccacccggaccaaagtcagcatccggtgcttcgccttctgctgccgcttttaaatcccagcccgcggaaaagaacttctctccggcaccggtaataatggcgacacgtaattgcggatcgtcacggaaatttagaaatacttcgcccatttcaaagctggtttttgcatcaatagcattcgcttttggacgatcaagggtaatttccagaattgatccattgcgggtcagatgtaatgattcactcattccttttctccatttttgctttttcagggacgacaacatccctgcaaaaaatgcatattgttttagagtgtgattattagctggcagggtagttccctgctgtttcatttatttcagattctttctaattattttccccgagcaattacgtggcagatcttttctgatctccagataagagggcactttaaatttcgccatattttgttcgcagaagcggaaaaattcctcttcgctcaatgtttcaccttcattcagcaccacaaatgctttgatggcttcatcgcgaatcgaatctttaatacccacaaccacgatgtcctgaattttcgggtgcgcggcgataatattttccagctccacgcaggagacattctcgccgccacgtttaatcatattgcagcggcgatcgacgaaataaaaaaagtcctcttcgtcgcggtatccggtatcgccggtatgcagccagccatcggcttccagcactttcgcagtggcttgtgggttgagaaagtactctttgaagatggttttcccaggtatgcctttaatgcagatttcaccgatctcaccagccgggagcgggcgattgtgatcgtcgcggatctccgcttcgtagcaaaaccccacccgaccaatcgacggccagcgtcgtttatcgccaggacgatcgccgataatgcccacaatggtttccgtcatcccataagacgtcagcaagcgaacgccgaagcgttcacaaaacgcatctttttcctgctccgacaagttgagataaaacatcacttcccgcaggcggtgttgctgatcgttcgctgaaggcggctgtaccatcaacgtacggatcatcatcggaatacattcggtaacggtggcgcggtacttctgtacctgtccccagaaggcgcgggcgctgtatttctcgaccagcacaaaggtggccccggcagaaaacgccgccatcgccgcagtacactggcaatcgatatgaaacgcaggcattaccgtcaggtagacgtcatcgtcacgcagtgcacactgccaggcggagtaatatccagcgaagcgcaggttgtaatgggtaatcaccacacctttcggtcgggaggtggtgccggaggtgaagagaatttccgccgtatcgtcagtcgatagcggcggtgcatagcacaaggtggcaggttgttgatttttcagttgagtaaacgaactcacgccatcatcagcgggaagtgccacatctgtcaggcaaatgtgccgcaattgagtggcatcttcctgctgaatctgttgatacataggatagaattgcgcactggtcaccagcaggcacgcctggctattttgcaggatccacgcgctttcctcgcacaacaggcgggcgttaatcggcaccataatcgcgccaatttttgccagcccgaaccagcaaaagataaattccgggcagttgtcgagatgtagtgcaaccttgtcgcctttgcgaatccccagcgtataaaacaggtttgccgtgcggttaatctcctgatttaactcaagataactataccggttaacgactccgccgctggattcacaaatcagcgccgttttatgaccgtaaacgtccgcaagatcgtcccacatttgacgtagatgttgtccgccaatgatatccattgcacctctatccatttttgttcgtttgttattgggcgggcgctagtcaggcaagccgactgacgccacgcgtttagtcctcaactttggccagacctttgctgaccaactcctgaatgtcgttttcgctgtagccgatatttttcaaaatggcagccgtgtccatgccatgtgagggcattccgcgccagatttgtccggggttatttttgaatttcggcatgatgttcggccctttgcaggtgcgaccatccatcgtttgccactgagtgattgattcgcgagccacatactgtggattgctttccagttccggtacggtcagcactttggcgcaggcgatattcagttcagcaaagcgttcttttacttccgcgatggtatgtgtcgccagccaggcatcgagtttctcttcaaccagtgggccgtaagggcattcgatacggtggataagctgagtgccttccgggatttctggcgtgccaagcagatgtgcgaggccaatatctttaaagcactcttcaatttgggtaatgcccaccagttccatcacgatgtagccgtcggcacatttatacagaccgcaaccggcgtagtagggatctttacctttgctcatgcgcgggcacatttcgccgccgttgaagtaatccatcatgaagtactggcccatacgcagcatcacttcatacatggcgatgtcgatactttcgcctttaccggtttcacgcactttatgcagtgctgccagcgccgccgtggtggcggtcaggccagaaaagtaatcggcggtatacgggaaggcaggcattggctggtcaacatcaccgttctgaatcaggtaaccactaaaggcctgggcgatagtgttataggccggaagattggtgtactcctcggtgccgtactgaccaaaaccggacaggtgagcgataaccagtttcgggttgtgctgccacagtacttcatcggtaatgccacgacgggcaaaggccggacctttactggcttcgatgaagatatcggtggtttccattaatttcagaaacgcttcgcggccttcatctttgaaaatatttaacgacagcgcgtgcaaattgcggcgggagagttgcgggtagttcggttgaacgcgaatggtgtcggcccaggcgacgttctcgatccagataacttccgcgccccattctgcgaacatttgcccggcaaacggtccggcgatttcgataccggagaagacaacgcgcaatccggccaacggcccgaatttcggcatgggtagatgatccattatttgctcctgaaaaatttatgtagcgcatgactgccggatgcggcgtaaacgctttatccggcctacattcgtgctcccgtaggcctgataagacgcatcagcgtcgcatcaggcagcgcacggacttagcggtattgcttcagcaccgcacgacccagcgtcaggatctgcatttcgtcagatcccccggagacgcggtctacacgcagatcacgccagaagcggctgatgcggtggttgcccgcaatcccgacaccgcccagcacctgcattgcgctatccacaacttcaaatgccgcattggcgcagaagtatttgcacatcgctgcatcgccagaggtgatggtgccgttgtctgctttccacgctgcttcatacagcatgtttttcatggagtttaatttgatcgccatgtgggcgaatttttcctgaatcaactggaaacgaccaatagcctcgccaaactgcacgcgctgattggcgtagcgcgccgcatcttcaaaggcgcacatcgccgtaccgtagttggtgagggctaccaggaaacgttcatggtcgaactcttctttgacgcggttaaagccgttaccttcccgaccgaacatgtctttctcgtccagttccacgtcgtcaaaggtgatttcacagcagctatccatacgcagaccgagcttttcaagtttggtcactttgatgcccggtttgctcatatcaacaaaccattcggtgtagacaggtttgtccggagaagccccgtcgcgcgccatcaccacgatgtacggggtgtaggcgctgctggtaataaaacacttactaccattaagataaatcttaccatttctacgggtataagtcgttttcaggctacccacgtcggagcccgcgcccggttcggtaatcgctgagttccacatctgcttaccggtgccgcggaaagccataattttgtcgatctgctcttgtgtgccttcgcgcaggaaggtgttgaacccgcccggcaactggtacagcacataggttggtgcccccagacgtcccagctccatccacacggcggcgagagtaacaaaccccgcgtccagaccaccgtgctcttcagggatcagcagactgtcgatacccatatccgccagtgctttgacaaaacgttccgggtagacgctgtcacggtcgcactcggcaaaataggcctcccagttttcgctggccatcagttcgcggataccggcgacaaacagttcctgctcatcatttaaattaaaatccatctttcaacctcttgatattttgggggttaattaatctttccagttctgtttcgcgtctttaataaaggagagcgtcaccataatgttgacgaagaacagcgggcatcctccggcgataatggcggtttgaatcggtttcaggccgccgagcgccagcagaacaataccgataatgccaaccagaattgaccaaccgatacgcaccagcagaggtggttcttcaccatcgcgtacttcgcggcaagtggacatcgccagggtataagagcaggcgttaaccagcgtaacggtggcaataaagcagaggatgaagaagccccacatggtggcggtgctgagtggcagagcggcccaggtttcaatgatggcgcgcgccacaccgtactgttcgatcagatttggaatgttgatgatgtttttatctatcaacagcagagtgttactaccgagtacagtccacaggatccaggttgacgctgtcagccccagcaccatgccgaagcacagttcacgcacagtacgaccacgggagatgcgggcgaggaagatactcatctggatagcataaatcacccaccatgcccagtagaacacggtccagccctgcgggaagccgcctttagcgatgggatcggtatagaacaacatgcgcggcagatacatcagcaacatccccaccgaatcggtgaagtagttcatgatgaagctggcaccgctgacaatgaacacccaacccagcatcaggaagctcaggtaactacgcacgtcactggcgatacgtacccctttttgcagaccgcaagcgacgcaaatggcgttgaggataatccagcaggtaatgatgatagcgtccagttgcagggtatgcggaatgccaaacaaccattgcatacactcggtcaccagcggcgtggcaaggcccagactggtacccatcgcgaagatcaaggcgacgagatagaagttgtcgacgatagtgccgaacaaccctttggcgtgtttttcacctaccagcggcaccagtgtcgagctggggcgaatcacttccattttgcggacaaagaagaagtaagcgaaggcgactgaaaggaagctgtaagtggcccacggcagaggtccccagtggaacaagctgtaagccagccccaactctttcgcccctgtcgagttcggttctaagccaaacggcggggtggagatgtagtagtagatctcaatcgatccccagaacagtacggcagcagacgtacaggaggcgaacatcataaagatccaactggcggtgctaaattctggcggttcgttacctaaacgctttttggcatacgggccaaacaccagccagaaccaaccgaaaagcatcaccaccatataccattcaaatgcccatccccatacattggtgacgtaactgaatacagcattaataacgacattcgctgcatccagatctctgactgtaagccaacaaagtatgccgacgattattaacggcggaaagaaaaccttcggttctattcccgtttttctcttttcattcttcatgagttaattccactgtgaaaacgaatatttattttgcgttcccgtttgttttatttttgttaacatttaatataattattattaacctcgtggacgcgttaatggctaactcataatgggtattcaataagctgtattctgtgattggtatcacatttttgtttcgggtgaatagagggcgttttttcgttaattttgattaataatcagtttgttatgctctgttgtgagtaaaaaataacatctgactttcaatattggtgatccataaaacaatattgaaaatttctttttgctacgccgtgttttcaatattggtgaggaacttaacaatattgaaagttggatttatctgcgtgtgacattttcaatattggtgattaaagttttatttcaaaattaaagggcgtgatatctgtaattaacaccaccgatatgaacgacgtttccttcatgatttctggagatgcaatgaagattattacttgctataagtgcgtgcctgatgaacaggatattgcggtcaataatgctgatggttcattagacttcagcaaagccgatgccaaaataagccaatacgatctcaacgctattgaagcggcttgccagctaaagcaacaggcagcagaggcgcaggtgacagccttaagtgtgggcggtaaagccctgaccaacgccaaagggcgtaaagatgtgctatcgcgcggcccggatgaactgattgtggtgattgatgaccagttcgagcaggcactgccgcaacaaacggcgagcgcactggctgcagccgcccagaaagcaggctttgatctgatcctctgtggcgatggttcttccgacctttatgcccagcaggttggtctgctggtgggcgaaatcctcaatattccggcagttaacggcgtcagcaaaattatctccctgacggcagataccctcaccgttgagcgcgaactggaagatgaaaccgaaaccttaagcattccgctgcctgcggttgttgctgtttccactgatatcaactccccacaaattccttcgatgaaagccattctcggcgcggcgaaaaagcccgtccaggtatggtcggcggcggatattggttttaacgcagaggcagcctggtcagaacaacaggttgccgcgccgaaacagcgcgaacgtcagcgcatcgtgattgaaggcgacggcgaagaacagatcgccgcatttgctgaaaatcttcgcaaagtcatttaattacaggggatgctatgaacacgttttctcaagtctgggtattcagcgataccccttctcgtctgccggaactgatgaacggtgcgcaggctttagctaatcaaatcaacacctttgtcctcaatgatgccgacggcgcacaggcaatccagctcggcgctaatcatgtctggaaattaaacggcaaaccggacgatcggatgatcgaagattacgccggtgtcatggctgacactattcgccagcacggcgcagacggcctggtgctgctgccaaacacccgtcgcggcaaattactggcggcaaaactgggttatcgccttaaagcggcggtgtctaacgatgccagcaccgtcagcgtacaggacggtaaagcgacagtgaaacacatggtttacggtggtctggcgattggcgaagaacgcattgccacgccgtatgcggtactgaccatcagcagcggcacgttcgatgcggctcagccagacgcgtcacgcactggcgaaacgcacaccgtggagtggcaggctccggctgtggcgattacccgcacggcaacccaggcgcgccagagcaacagcgtcgatctcgacaaagcccgtctggtggtcagcgtcggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggcgctaacgcgtcgcaaaccattttcgccatcaataaagataaaaatgcgccgatcttccagtacgcggattacggcattgttggcgacgccgtgaagatccttccggcgctgaccgcagctttagcgcgttgatccactctggcagggctgcattttggccctgccgctgacagggagctcttatgtccgaagatatctttgacgccatcatcgtcggtgcagggcttgccggttcggttgccgcactggtgctcgcccgcgaaggtgcgcaagtgttagttatcgagcgtggcaattccgcaggtgccaagaacgtcaccggcgggcgtctctatgcccacagtctggaacacattattcctggtttcgccgactccgcccccgtagaacgcctgatcacccatgaaaaactcgcgtttatgacggaaaagtcagcgatgactatggactactgcaatggtgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaactccatccttgccgaaaaattggggatggcaaaacgcgtcaaaccgacggatgtggcggttggcgtgaaggaactgatcgagttaccgaagtcggttattgaagaccgttttcagttgcagggtaatcagggggcggcttgcctgtttgcgggatcacccaccgatggcctgatgggcggcggcttcctttataccaatgaaaacaccctgtcgctggggctggtttgtggtttgcatcatctgcatgacgcgaaaaaatcggtgccgcaaatgctggaagatttcaaacagcatccggccgttgcaccgctgatcgcgggcggcaagctggtggaatattccgctcacgtagtgccggaagcaggcatcaacatgctgccggagttggttggtgacggcgtattgattgccggtgatgccgccggaatgtgtatgaacctcggttttaccattcgcggtatggatctggcgattgccgccggggaagccgcagcaaaaaccgtgctttcagcgatgaaaagcgacgatttcagtaagcaaaaactggcggaatatcgtcagcatcttgagagtggtccgctgcgcgatatgcgtatgtaccagaaactaccggcgttccttgataacccacgcatgtttagcggctacccggagctggcggtgggtgtggcgcgtgacctgttcaccattgatggcagcgcgccggaactgatgcgcaagaaaatcctccgccacggcaagaaagtgggcttcatcaatctaatcaaggatggcatgaaaggagtgaccgttttatgacttctcccgtcaatgtggacgtcaaactgggcgtcaataaattcaatgtcgatgaagagcatccgcacattgttgtgaaggccgatgctgataaacaggcgctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctgatgttggtttgatacgtaacgccgcactgactctcattgcaaaaaacaggaataaccatgcaaccgtccagaaactttgacgatctcaaattctcctctattcaccgccgcattttgctgtggggaagcggtggtccgtttctggatggttatgtactggtaatgattggcgtggcgctggagcaactgacgccggcgctgaaactggacgctgactggattggcttgctgggcgcgggaacgctcgccgggctgttcgttggcacatcgctgtttggttatatttccgataaagtcggacggcgcaaaatgttcctcattgatatcatcgccatcggcgtgatatcggtggcgacgatgtttgtttcatcccccgtcgaactgttggtgatgcgggtacttatcggcattgtcatcggtgcagattatcccatcgccacctcaatgatcaccgagttctccagtacccgtcagcgggcgttttccatcagctttattgccgcgatgtggtatgtcggcgcgacctgtgccgatctggtcggctactggctttatgatgtggaaggcggctggcgctggatgctgggtagcgcggcgatcccctgtttgttgattttgattggtcgattcgaactgcctgaatctccccgctggttattacgcaaagggcgagtaaaagagtgcgaagagatgatgatcaaactgtttggcgaaccggtggctttcgatgaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttgggattgggggttggcaaaaacgcggcactagggaatgtggtgattagcctgttctttatgctcggctgtattccgccgatgctgtggttaaacactgccggacggcgtccattgttgattggcagctttgccatgatgacgctggcgctggcggttttggggctaatcccggatatggggatctggctggtagtgatggcctttgcggtgtatgcctttttctctggcgggccgggtaatttgcagtggctctatcctaatgaactcttcccgacagatatccgcgcctctgccgtgggcgtgattatgtccttaagtcgtattggcaccattgtttcgacctgggcactaccgatctttatcaataattacggtatcagtaacacgatgctaatgggggcgggtatctcgctgtttggcttgttgatttccgtagcgtttgccccggagactcgagggatgtcactggcgcagaccagcaatatgacgatccgcgggcagagaatggggtaaattgttcagatttctctcttttctgaatcaatattattgactataagccgcgtgaatatatgactacactttgtgggaaaacaaaggcgtaatcacgcgggctacctatgattcttataatttatgcgcatccgtatccgcatcattcccatgcgaataaacggatgcttgaacaggcaaggacgctggaaggcgtcgaaattcgctctctttatcaactctatcctgacttcaatatcgatattgccgccgagcaggaggcgctgtctcgcgccgatctgatcgtctggcagcatccgatgcagtggtacagcattcctccgctcctcaaactttggatcgataaagttttctcccacggctgggcttacggtcatggcggcacggcgctgcatggcaaacatttgctgtgggcggtgacgaccggcggcggggaaagccattttgaaattggtgcgcatccgggctttgatgtgctgtcgcagccgctacaggcgacggcaatctactgcgggctgaactggctgccaccgtttgccatgcactgcacctttatttgtgacgacgaaaccctcgaagggcaggcgcgtcactataagcaacgtctgctggaatggcaggaggcccatcatggatagccatacgctgattcaggcgctgatttatctcggttcggcagcgctgattgtacccattgcggtacgtcttggtctgggatcggtacttggctacctgatcgccggctgcattattggcccgtgggggctgcgactggtgaccgatgccgaatctattctgcactttgccgagattggggtggtgctgatgctgtttattatcggcctcgaactcgatccacaaaggctgtggaagctgcgtgcggcagtgttcggctgtggcgcattgcagatggtgatttgcggcggcctgctggggctgttctgcatgttacttgggctgcgctggcaggtcgcggaattgatcggcatgacgctggcgctctcctctacggcgattgccatgcaggcgatgaatgaacgcaatctgatggtgacgcaaatgggtcgcagtgcctttgcggtgctgctgttccaggatatcgcggcgatcccgctggtggcgatgattccgctactggcaacgagcagtgcctcgacgacgatgggcgcatttgctctctcggcgttaaaagtggcgggtgcgctggtgctggtggtattgctggggcgctatgtcacgcgtccggcgctgcgttttgtagcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggagagcgatatcgaaccatttaaaggtttgctgttggggctgtttttcatcggtgttggcatgtcgatagactttggcacgctgcttgaaaacccattgcgcattgtcattttgctgctcggtttcctcatcatcaaaatcgccatgctgtggctgattgcccgaccgttgcaagtgccaaataaacagcgtcgttggtttgcggtgttgttagggcagggcagtgagtttgcctttgtggtatttggcgcggcgcagatggcgaatgtgctggagccggagtgggcgaaatcgctgaccctggcggtggcgctgtcgatggcagcaacgccgattctgctggtgatcctcaatcgccttgagcaatcttctactgaggaagcgcgtgaagccgatgagatcgacgaagaacagccgcgcgtgattatcgccggattcggtcgttttgggcagattaccggacgtttactgctctccagcggggtgaaaatggtggtactcgatcacgatccggaccatatcgaaaccttgcgtaaatttggtatgaaagtgttttatggcgatgccacgcggatggatttactggaatctgccggagcggcgaaagcggaagtgctgattaacgccatcgacgatccgcaaaccaacctgcaactgacagagatggtgaaagaacatttcccgcatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgtgccgatgtgttccgccgctttaatattcagatggtggaagagatggcaatggttgagaacgacaccaaagcccgcgcggcggtctataaacgcaccagcgcgatgttaagtgagatcattaccgaggaccgcgaacatctgtcattaattcaacgacatggctggcagggaaccgaagaaggtaaacataccggcaacatggcggatgaaccggaaacgaaaccctcatcctaataaagagtgacgtaaatcacactttacagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgggtacggacgatcgcgtaacgtgggtgaagtcggtggatgaagccatcgcggcgtgtggtgacgtaccagaaatcatggtgattggcggcggtcgcgtttatgaacagttcttgccaaaagcgcaaaaactgtatctgacgcatatcgacgcagaagtggaaggcgacacccatttcccggattacgagccggatgactgggaatcggtattcagcgaattccacgatgctgatgcgcagaactctcacagctattgctttgagattctggagcggcggtaattttgtatagaatttacggctagcgccggatgcgacgccggtcgcgtcttatccggccttcctatatcaggctgtgtttaagacgccgccgcttcgcccaaatccttatgccggttcgacggctggacaaaatactgtttatcttcccagcgcaggcaggttaatgtaccaccccagcagcagccggtatccagcgcgtatataccttccggcgtacctttgccctccagcgatgcccagtgaccaaaggcgatgctgtattcttcagcgacagggccaggaatcgcaaaccacggtttcagtggggcaggggcctcttccggcgattctttgctgtacatatccagttgaccgttcgggaagcaaaaacgcatacgggtaaaagcgttggtgataaaacgcagtcttcccagcccccgcaattccggtgaccagttatttggcatatcgccgtacatggcatcaagaaagaagggataggagtcactcgatagcaccgcttctacatcgcgtgcgcactctttggcggtctgcagatcccactgcggcgtgatccctgcgtgggccatcaccagctttttctcttcgtcgatttgcagcagaggctggcgccgcagccagttaagcagctcgtcggcatccggcgcttccagcagcggtgtcaggcgatctttcggtttattgcggctgatcccggcaaataccgccagcagatgcagatcgtgattgcccagcaccagacgtacgctgtcgcctaaggatttcacatagcgcagaacatccagcgaacccggcccgcgcgcgaccagatcgcccgtcagccagagggtatctttcccaggggtaaattctactttatgcagcaatgcgatcagttcatcgtaacaaccatgaacgtcgccaataaggtatgtcgccatattcttttaatgaatgagtgtgggaacggcgagtcggaatacgggaatgtcgatgctgaaagggacgccattttcatcgatcatttcgtagtgaccctgcatggtgcccagcggggtttcaatgattgcaccgctggtgtactggtactcttcgccaggcgcgataagtggctggacgccaaccactccttcgccctggacttcggtttcacggccattgccattggtgatcagccagtaacgccccaacaactgcactggcgctcgccccagattgcgtatggttacggtataagcaaaaacgtaacgttcattatcaggtgaagattgagcctcaatgtagacgctttgaacctgaatacacactcggggcgaattgatcatcgttaactctcctgcaaaggcgcgttctccgccagatagttcgccatctggcaatattgcgcgacagagatattttccgctcgcatcgccgggtcgatccccattcccgttaacacctcgacgctaaacaggttgccgaggctgttacgaatggttttacgacgctggttaaaggcttcggtggtgatgcggctcaacacacgaacatctttaaccgggtgaggcatcgttgcatgaggaaccaggcgcacgacggcggaatccactttgggtggtggtgtaaaggctgacggcggtacttccagtaccgggatcacattgcaatagtattgcgccatgacgcttaatcgaccatacgctttgctgttcggtcctgcaaccagacgattcaccacctctttttgcaacataaagtgcatgtcggcaatggcatcagtatagctaaacagatggaacatcaacggcgtggagatgttataaggcaggttgccgaaaacacgcagcggctgacccattttctcggccagttcaccaaagttaaaggtcatcgcatcctgctgataaatcgtcagtttcgggcctaagaatggatgcgtttgcagacgtgccgccagatcgcggtcaagttcgatgaccgtcagctggtccagacgttcgccgaccggttcggtcaatgccgccagaccggggccgatttcgaccatcgcctggcccttttgcgggttaatggcagacacaatactgtcgatcacgaactgatcgttgagaaagttttgcccgaagcgtttacgggctaagtggccctggtggactcgattattcattgggtgttaacaatcattttgatggcgagattaagcgccgtaataaaactgccgacatcggctttgccacgtcccgccagttcaagcgcggtgccgtggtccactgatgtgcgaataaagggcaggcccagcgtaatgttcacaccgcgcccgaagccctggtattttagcacgggaagaccctgatcgtggtacatcgccagcacggcgtcggcgttatcaagatatttcggctgaaacagggtatcggcaggcagcggcccgttgagtttcatcccctgcgcccgcagctcattgagcaccggaataatggtgtctatctcttccgtacccatatgaccgccttcgcccgcgtgcggattcagcccgcagaccagaatgcgcggttcggcaataccaaatttggtccgcaaatcgtgatgcaaaatagcaatcacttcgtgcaaaagtgcaggggtgatagcgtctgcgatatcgcgcagcggtaaatgcgtcgttgccagcgccacgcgaagttcttcggtcgccagcatcatcaccacctttttcgcctgcgaacgctcttcgaaaaactcggtatgaccggtaaaaggaatgccagcgtcgttaataacgcctttatgcaccggacctgtgatcagcgcggcaaattcgccgttcagacaaccatcgcacgctcgcgccagcgtttccaccacataatgcccattttcaaccgctaactgccccgcagtgacaggtgcacgtagcgcgacaggaagtagcgttaatgtgcccgcagtttgcggttgtgcaggggagttgggggaataagggcggagggtgagcggcaaaccgagcatcgctgcccggttggtaaggagagtggcatcggcacaaacaaccagttcgaccggccactcacgctgtgcaagctggacaactaagtccgggccaatcccggcgggctcgccgggagtgatcacaacacgttgggttttaaccattagttgctcaggattttaacgtaggcgctggcacgttgttcctgcatccagcttgctgcttcttccgagaacttacggttcatcagcatgcggtatgcacgatctttctgcgcagcgtcggttttatcgacattacgggtatccagcagttcgattaaatgccagccgaatgaagagtgaaccggtgcactcatttgacctttgttcaggcgagtcagggcgtcacggaaggccggatcgaaaatatctggtgtagcccagccgagatcgccgccctggttagcagagcctggatcctgagagaactctttcgctgcggcagcaaaagtcgttttaccactcttgatatcagcagcaatctgttccagtttcacacgggcctgttcgtcagtcatgatcggcgacggtttcagcagaatatggcgagcatgaacttcggtcaccgagatatttttgctttcgccgcgcaggtcgttaactttcagaatatggaagccaacgccggaacgaatcgggccaacaatgtcgcctttcttcgcggtgcttaatgcctgggcgaagatcccgggcaactcctgaatacggccccagcccatctggccgccgttcagcgcctgctggtcggcagaatgagcaatcgccagcttaccgaaatcagcgccgttacgcgcctgatcgacaatggcgcgcgcctggctttccgcttcgttcacctgatcagaggtcgggttttccggcagcgggatcaggatgtggctcaggttcagctcagtgctggcgtcgttttggttacccacctgctgcgccagggattcgacttcctgcggcaggatggtgatgcgacgacgcacctcgttgttacgcacttcagagataatcatctctttgcggatctggttacgataggtgttgtagttcagtccatcgtaagccagacggctgcgcatctgatccagcgtcatgttgttctgtttcgcgatgttagcaatcgcctgatccagctgctcatcggagattttcactcccattttctgccccatctgcaggatgatttgatccatgatcaaacgttccatgatttggtggcgcagcgtcgcgtcatcaggaagttgctgccttgcctgagcagcgttcagttttaccgactgcattaatccatcaacgtcgctttccagcacgacgccgttattgacgacggctgcgactttatcgactacctggggggcagcgaaactggtattcgcgatcatggcgataccgagaagcagcgttttccagttcttcatactttttccatttcaattaaccgcactgcggattacgtggtaaatcaacaaatcacaaagtgttttgatacggcagaatgttcgaacgcagcatctcttgcgtacccagaccgtagttggagctcaggccgcgaagttcgatgttaaagccgattgcgttgtcatataccgcatgttgtttatcgttatcccaaccgttcagcttccgctcgtaaccgacgcgaattgcatagcagcaggagctgtattgcacacctaacatagagtcggcttgcttgttagcattggtgtcgtagtagtaggccccaacaatggaccaacgatcggcaattggccagctggcgacagcacctacctgcgaaataccattcttatattgctcagcagtggaatagtacttaggcagcgtagcctgaatatattccgggctggcgtaacggtaattcagctgtaccagacggtcttcatcccgacggtattcaatgctggagttactggtcgctacgttatccagacgtgtatcgtactgaatcccgccacgcaatccccaacgctcggagatacgccagtaagtatcgcctgcccacaccagtgaacccgttttgtcgtcattctcccatgttatgttgtcatcgccagtgcgagactccgtgaaatagtagatttgaccaacggaaatattaaaacgttcaacggcagcatcatcatatatgcgagatgtgacaccggtcgtcacctggttagcggaggcaatacggtcaagaccgccgtaagtccggtcccggaacaggccagagtagtcagattgcagcagagacgagtcgtagttatagatgtcgctctgatcgcgatacggcacgtacaaatactgcgcgcgcggttccagcgtttgggtataacccggagccagcatttccatatcgcgttcaaagaccattttgccgtcaactttgaattgcggcattacgcggttaacggattcgtccagcttggtcgtgtttctggagttataccagtcaagattggtttgctgataatgggttgccagcaacttcgcttcggtattgatgctgccccagttattagagagcggcaaattgatggtcggttccaggtgaacacgggttgcttcaggcatgtcgtctctggtgttaacaaagtgcactgcctggccgtaaatacgcgtatcaaacggaccaacatcattctggtagtaattaacgtctaactgcggctctgccgagtagctactggtgttctgttcgctgaaaacctggaactgcttggttgaaacggtggcattgaagttttgcaccgcatagccaacgctgaatttttgcgttgcgtagccgtcagtactggaaccgtacttgttatcgaaatcattgaagtagctaggatcgctgaccttggtgtagtcgacgttgaaacgccacacctgatccatgaccccggagtggttccagtagaataaccaacgacgtgaactgtcatcgttcgggtgttcatcttcatagactttatctgaaggcagatagtccagttccatcaagccagcgcccgcctgggagaggtagcggaattcgttctcccacatgatgttgccacgacgatgcatataatgcggcgtgatggtggcatccatatttggcgcgatgttccagtaatatggcaggtagaactcaaagtagttggtggtggtgtacttggcgttcgggatcaagaaaccagagcgacgtttgtcacccaccggcaactgcaaataggggctataaaagatcggtaccggacccaccttaaagcgggcgttccagatctccgcaacttgttcttcgcggtcatgaataatttcgctacctaccacgctccaggtgtcagaacccggcagacaggaggtaaagctaccgttatccagaatggtatagcggttttcgccacgttgtttcatcaggtccgctttaccgcgaccctggcgacccaccatctggtaatcaccttcccagacgttggtatctttggtgttcagattcgcccagcctttcggccctttgaggatcacctggttatcgtcgtaatggacattaccgagcgcatcaacggtacgtaccggctccggttgtcctggtgcctctttttgatggagctgcacttcgtcggcctgcagacggctgttaccctgcatgatatccacgctgccagtaaacacggcgtcatccgggtagtcccctttcgcgtggtcagcattgatagtcacgggtaagtcattggtatcgccctgtaccagaggacggtcatagcttggcacgcccaacatgcactgtgaggcgaggtcggctgccagtccctgttgactataaagggcggtggcaatcatggtggccaggagagtggggatacgttttttcatacgttgattttattgttccatcatcggtaacgttgcgcgtgacaaacggtcagagactaacgtactcgtcatctctacgctagtgttaatcctgtccgaatagcgtcagtggtgttaggcacggcattgaatgacaggtatgataatgcaaattataggcgatgtcccacaattgaccgcagccggaaaacggtaaaagcacctttatattgtgggagatagccctgatatccgtgtgtcgatttggggaatatatgcagtattggggaaaaatcattggcgtggccgtggccttactgatgggcggcggcttttggggcgtagtgttaggcctgttaattggccatatgtttgataaagcccgtagccgtaaaatggcgtggttcgccaaccagcgtgagcgtcaggcgctgttttttgccaccacttttgaagtgatggggcatttaaccaaatccaaaggtcgcgtcacggaggctgatattcatatcgccagccagttgatggaccgaatgaatcttcatggcgcttcccgtactgcggcgcaaaatgcgttccgggtgggaaaatcagacaattacccgctgcgcgaaaagatgcgccagtttcgcagtgtctgctttggtcgttttgacttaattcgtatgtttctggagatccagattcaggcggcgtttgctgatggttcactgcacccgaatgaacgggcggtgctgtatgtcattgcagaagaattagggatctcccgcgctcagtttgaccagtttttgcgcatgatgcagggcggtgcacagtttggcggcggttatcagcagcaaactggcggtggtaactggcagcaagcgcagcgtggcccaacgctggaagatgcctgtaatgtgctgggcgtgaagccgacggatgatgcgaccaccatcaaacgtgcctaccgtaagctgatgagtgaacaccatcccgataagctggtggcgaaaggtttgccgcctgagatgatggagatggcgaagcagaaagcgcaggaaattcagcaggcatatgagctgataaagcagcagaaagggtttaaatgaccctgtaaatgatgctgagtaactgcccacgattaaaggtggccgccctggcggtcacttctttgagaaaaggcgtttactcagaatggtggacaggctcaatgcacggtttacgggaggggttctgtaggttttatcgcgttgaccctgcttaaggttgagagctttacgacgagcggaattatatttttacgtcttaaaaataaaaaacacatacctgaatgagcgatttttgaaagtatatttattcagaacgcgcatcatgagtttttaactcaatgcgaggctattaccatgaaagtatcagttccaggcatgccggttacacttttaaatatgagcaagaacgatatttataagatggtgagcggggacaagatggacgtgaagatgaatatctttcaacgcttgtgggagacgttacgccatctgttctggtcagataaacagactgaggcttataaacttctgttcaatttcgtgaataaccagactggcaacatcaacgcctcagaatactttactggggctatcaacgagaatgagagagaaaagtttatcaatagcctggaattattcaataaacttaaaacatgcgcaaaaaatccggatgagttggtcgcaaagggcaatatgcgctgggtcgcccagaccttcggggatatcgagttaagtgtcacttttttcattgaaaagaataagatatgtactcagacgttgcagctgcataagggccaaggtaacttgggcgttgatcttagaaaggcttaccttcccggcgttgacatgagggattgttaccttggtaaaaaaacaatgaaaggtagcaatgatatcctttatgagagacctgggtggaatgctaacctgggcgtgctaccccggacggtgctaccccggacggtgctaacccggacggtgctaacctggacggtgctaccgtgaacggtgctacctccttatatgatgaggtaattattattaataaaatcccccccaaaaaaattgatactaaaggagttgctactgaagaagttgctactaaaaaagtactgctgaacaaattactgacaacgcaattattgaatgagccagaataagctaaggttgaaggggctggaacgccccttcaaccttagcagtagcgtgggatgatttcacaattagaaagacctgcatgatgagctagagaagaggctagtgacgcaaggcgtcgtgcaggacacggatcaccgagatgggcatcgccaaccagactgctaattagcccatgaataacaatcagaaaggaccataacagacccgttaaaatgaaatataagagacggtcaacgggtgaagaaaaagttcaaaaattcgctgtggagcaggaagggaattaccgaatggaaagcgtagccacacgcaacaactgaaagcagtttggcagaaacaaaaaatccccggactcggggatttatgtacaagaggcagcccttaggatgagggtataaacgtacaggaaaggttaaaaatccgctggcgctttaaacgtcatactattgccatacgccggatgggtaatcgtcaacatctctgcatgtagcaacaaacgtggtgccatcgctctcgcttctggtgatgcataaaaacgatcgccgagaatcggatgacccagcgccagcatatgcacacgcaattgatgcgaacgcccggtaatcggttttaacaccactcttgccgtgttatccgccgcatactccaccacttcatattccgtctgcgcaggtttacccgtttcgtaacagactttctgtttcgggcggtttggccagtcgcaaatcagcggcagatccaccagaccttctgcgggggatggatgcccccagacgcgggccacatactgctttttcggctcgcgctcgcggaactggcgttttaactcccgctccgcggctttggtcagcgccactacaatcacgccgctggtagccatatccagacgatgcaccgattctgcctgcggataatcacgctgaatgcgcgtcatcacgctgtctttgtgctcttccagacgacccggcactgacaacaaaccgctcggcttgttgaccaccataatatggtcatcctgatacaggataaccaaccagggttcctgcggtggattgtagttttccatccccattttcggctccgttactgatgcgttacaacgatcaaacgcagggcatccagacgccaacctgcctgatccaggctttccattacctgctgacggttgctctcaatggcggtcagttcgtcgtcacgaatgttcgggttcactgcacgcagagcttccagacgagacagctcggcagacagtttttcgtcggcttcgttacgcgctgcatcaatcaatgcacgggcagatttctcgatctgcgcttcacccagttgaaggatagcgtgaacatcctgctgcacggcgttaaccagtttgctgccggtgtgacggttaaccgcgttaagctggcggttaaaggtttcaaactctacctgcgccgccaggttgttgccgtttttatccagcagcatacgtaccggcgtcggtggcaggaagcggttgagctgcaactgcttcggagcctgggcttcaaccacataaatcagttccaccaacagcgtacctaccggcaacgctttgttttttaacagtgaaatcgtgctgctaccggtatcgccagaaaggatcagatccagaccgttgcggatcagcggatgctcccaggtaataaactgtgcatcttcacgcgccagcgccacttcacgatcaaaggtgatggtgatgccatcttccgacaggccagggaagtccggcaccagcatatgatcggacggcgtcagcacgatcatgttgtcgccgcgatcgtcctgattgataccgataatatcgaacaggttcatggcgaaggcgatcaggttggtatcgtcatcctgctcttcaatgctttctgccagtgcctgggctttttcgccaccgttggagtggatttccagcaggcggtcacgaccctgttccagctgtgctttcagcgcttcatgttgctcgcggcagtttttgatcagatcgtcaaagccttcggtttgatccggtgaagccagatagttaatcagatcgttgtatacgctatcgtaaatagtgcgtccggtcgggcaggtgtgctcaaatgcatccagaccttcgtgataccagcgcaccagcaccgactgagcggttttctccagataaggcacatggatctgaatatcgtgcgcctggccgatacgatccagacgaccaatacgctgctccagtagatccgggttgaatggcaggtcaaacatcaccatgtggctggcgaactggaagttacgtccttcagaaccgatttctgagcacagcagtacctgtgcgccggtgtcttcttcggcaaaccaggcggcagcgcggtcacgttcgataatcgacataccttcgtggaacaccgcagcgcgaataccttcacgttcgcgcagtacctgctccagttgcagcgcagtggcagctttggcgcagatcaccagcactttctgagagcgatggctggtcaggtagcccatcagccactcaacgcgcggatcgaagttccaccaggtggcgttatcaccttcaaattcctgataaatacgctccgggtagagcatatcgcgagcacgatcttccgcacttttacgtgcgcccataatgccggagactttaatagccgtctgatactgcgtcggtagcggcagcttaatggtgtgcagctcgcgtttcgggaatcctttcacaccgttacgcgtgttacggaacagcacgcggctggtgccgtggcgatccatcagcatcgaaaccagctcctgacgggcgctctgggcatcttcgctgtcgctgtttgctgcctgcaacagcggctcgatatcctgctcgccgatcatctcgccgagcatgttcagttcgtcattgctcagtttgttacctgccagcagcatggcaacggcgtccgcaaccggacgataatttttctgctcttcaacgaactgcgcaaaatcgtggaaacggttcgggtccagcagacgcagacgggcgaagtggctttccatccccagctgttccggggtcgcggtcagcagcagaacgcccggcacgtgctctgccagttgttcaatggcctgatattcacggcttggcgcatcttcgctccacaccaggtgatgcgcttcatcgaccaccagcaggtcccattcggcttcacagagatgttccaggcgctgtttgctacgacgggcaaaatccagcgagcaaatcaccagctgttcggtgtcaaacgggttgtaagcatcgtgctgagcttcggcataacgctcatcatcaaatagcgcaaagcgcaggttgaaacggcgcagcatttctaccagccactgatgctgtaaggtttccgggacgataattagcacacgttcagcagcgccagagagcagttgctgatgcaggatcatcccggcttcaatggttttccctaaacccacttcgtcagccagcaggacgcgcggcgcgtggcggcgaccaacatcatgagcgatgttgagctgatgcgggatcaggctggtacgctgaccgcgcaggccgctgtacggcatacggaactgttcgctggaatatttacgcgcgcgataacgcagcgcaaagcggtccatacggtcaatctgcccggcaaacagacggtcctgcggtttgctgaacaccagtttgctatcaaggaaaacttcacgcagggctacgccggactcttcagtatccaggcgagtaccgatataggtcagcaagccattttcttcttttacttcttcgacttgcatctgccagccgtcatggctggtaatggtatcaccagggttgaacatcacgcgggtcacgggggaatcactgcgtgcgtacagacggttttcaccagtagatgggaaaagtaaagtgacagttcgcgcatccaccgcgacaacggttccaagtcccaattcgctttctgtatcgctgatccagcgttgaccaagtgtaaaaggcatatgtgttcggctctatatctttaattgcaggcaataaccacccgctaccgtgcttatgaggtagtggtgttattcaggtccaggaatggaaagggcgctatggtactggatggcaaagcattcgtcacgcatcaaaatggtatctggcgaactcttttttttgctcaaaatagcccaagttgcccggtcataagtgtagcaaaattatcctcaataaaagggagtattccctccgccacgggttgtagctggcgggtcagatagtgttcgtaatccagtggtgaacgttggtagtccagcggctccgggccgttggtggtccatacgtacttaatggtgccgcgattctgatattgcaaggggcgaccacgcttttggttttcttcatcggcaaggcgagcggcgcgtacatgaggcggcacattacgctgatactcgctcagcggacggcgaaggcgtttacggtaaaccagtcgcgcatccagttcacccgccatcagtttgtcgatggtttcgcgtacatattcctgatatggctcgttgcggaagatgcgcaggtatagctcctgctgaaactgctgggccagcggcgtccagtcggtgcgcacggtttccagccctttaaacaccatccgctgcttgtcgccctcctgaatcagtccggcataacgctttttactgccggtatcggctccgcgaatggttggcatcagaaaacggcagaaatgggtttcatactccagttctaatgcgctggtcagccgttgtttttgcagcgtttccgcccaccaggcgttaacgtgctgcaccagtgcacgaccgattttcgccgcttcttcttccgaatgtgcgcctttcagccagacaaacgttgagtcggtatcgccgtagataacgtcgtagccctgtgcttcaatcaacgctttggtttgccgcatgatctgatgaccacgcatggtgatcgacgatgccagccgcggatcgaagaagcggcaggcggtggtgccgagcacgccataaaaggcattcatgatgattttcagcgcctgcgacagcggtttgttaccctggcgtttggcttcatcgcgcccgtgccagatgttagtcacaatctccggcaggcaatgtttttctcgcgagaaccaggcatcgagaaaaccttcggtactgtgctctggatcaggctgcgccatgccttccaccagcccgacgggatcaatcagaaaggtgcggatgatcgacgggtacaggcttttatagtccagcaccagcactgaatcataaagccctggccgtgaatccatcacgtagccgccagggctggcgtgcggcggcacttcgccgagattaggcgcgacataaccagcgcgatgcattcgcggaaaatagagatgaccaaatgccgccaccgaaccgccgtgtcggtccaccggcaggccgttcaccgttgcccgttcgagtaaaaatggcatgatttcagttttgtggaagatctgcgtcaccagctcgcaatctttcaggttataagttgccagcgcaggtttatcttcggcgaaacggcggtcaatttcgtccattcgatcccacgggttatcgatagattttccttcgcctaatagctcctgagcgacagtttccagcgagaatgaagagaaattccagaacgcggatttcagcgcctcgataccgtcgataattagccgacctttagcctgggcaaaaaagacgccgtttttaaagccgtgctcgcgccactccagctcgctattatcgcgcccaagacgcagcggaagacggtaacgctcggcatgtttttgcagcattcgcagatcgaactgcaccacgttccaaccgatgatcacatcaggatcgtagttggcaaaccaggcgttgagtttttccagcaactgcgggcggctggcgacgtattccagttcgaaatcaagcgaggaggcgtcgccattctccggccccagcatataaacgatgcgctgcccgcagccttccaggccgatgcagtacagctcaccgtggcgggtggtttcaatatctatagaaacccacttgagcggcggacgatagtcgggatgcggtttcagacgggcattaacgatagtgccattgtgcatatcaccctcgacccacaccggtgaggtgataaaccgctccatcagatagcgttctggcggacgcacatcggcctcgtagacggtaacgccaccttcacgcaggcgcttttcgtaattcatcaattggcgatgggcgcgacagtaaaggccatacaccggctggcggtgaaaatcctttaacgccagcggtgtcaggcgaaagccttgttcaccctgcaaaatatgctgagcgcggggaacctgatcggcgggaataaacgccacggactcttgcggtgcaagcgtaacctgcaacggcccgttgtccgtcgccagccagaaggagacttctgtcccttgcggggtgtcccgccagtgtcgggttaagataaaacctgcctgcgccacgctgaaaatccatcaaaaaaccaggcttgagtatagcctggtttcgtttgattggctgtggttttatacagtcattactgcccgtaatatgccttcgcgccatgcttacgcagatagtgtttatccagcagcgtttgctgcatatccggtaactgcggcgctaactgacggcagaatatccccatataagcgacctcttccagcacgatggcgttatgcaccgcatcttcggcatttttgccccatgcaaacgggccgtgggaatggaccagaacgccgggcatttgcgctgcatcgataccctgtttttcaaaggtttctacgatgacgttaccggtttcccactcatattcgccgttgatttctgcgtcggtcattttgcgggtgcagggaatggtgccgtagaaatagtcggcgtgggtggtgccggttgctggaatcgactgacccgcctgcgcccagatggtggcgtggcgcgagtgcgtatgcacaatgccgccaatggaggggaatgcctgatagagcagccggtgagttggcgtgtcggaggagggctttttcgtaccttcaaccacttcaccggtttcgatgctaaccacgaccatatcgtcagcggtcatgacgctgtaatcgacgccggaaggtttgatcacaaagacgccgcgctcgcgatcaacggcgctgacgttgccccatgtgagcgtgaccaggttgtgttttggcagcgccaggttggcttctaatacctggcgtttgagatcttctaacatgttgactccttcgtgccggatgcgctttgcttatccggcctacaaaatcgcagcgtgtaggcctgataagacgcgccagcgtcgcatcaggcgttgaatgccggatgcgctttgcttatccggcctacaaaatcgcagcgcgtaggcctgataagacgcgccagcgtcgcatcaggcgttgaatgccggatgcgctttgcttatccggcctacaaaatcgcagcgtgtaggccagataagacgcgtcagcgtcgcatcaggcgttacataccggatgcggctacttagcgacgaaacccgtaatacacttcgttccagcgcagcgcgtctttaaacgctggcaggcgtgtgtcgttatcaatcaccgtgatttcaatgtcgtgcatctcggcgaattggcgcatatcgttgaggttcagtgcatggctgaagacggtatggtgcgcgccaccagcgaggatccacgcttcggaagcagttggcagatccggttgcgctttccacagcgcattcgccaccggcagtttcggcagggagtgcggtgttttcaccgtgtcgatgcagttaaccagtagacggtaacgatcgccgagatcaatcaagctggcgacaatcgctgggccggtttgggtattgaagatcaggcgggcaggatcgtccttaccaccaataccgagatgctgaacgtcgaggatcggtttctcttctgcggcgatcgacgggcagacttccagcatatgggagccgagcaccaggtcattacctttctcgaagtgataggtgtagtcctccataaaggaggtgccgccctgcagaccggttgacatcaccttcatgatgcgaagcagggcggcagttttccagtcgccttcgcccgcaaagccgtaaccctgctgcatcagacgctgtacggccagaccaggaagctgtttcagaccgtgcaaatcttcaaaggtggtggtgaacgcgtggaagccaccttgttccaggaaacgcttcatccccagctcaatacgcgccgcttccagcacgttctgtcgttttttgccgtggatttgtgtggcaggcgtcatggtgtagcagctttcgtactcatcgaccagcgcgttaacatcgccgtcgctgatggagttcaccacctgcaccagatcgccaaccgcccaggtattgacggagaaaccgaacttgatctgtgcggcaactttatcgccatcggtgaccgccacttcacgcatgttatcgccaaatcggcagactttcagatgacgggtatcctgtttagagaccgcctgacgcatccaggagccgatacgctcatgggcttgtttatcctgccagtgaccggtaaccacggcatgttgctgacgcatacgcgcgccaatgaagccgaactcgcgaccgccatgtgcagtctggttcaggttcataaagtccatatcgatactgtcccacggcagcgccgcgttgaactgggtgtggaattgcagcaacggtttgttgagcatggtcaggccgttgatccacattttggccggggagaaggtgtgcagccacaccaccagaccagcgcaacgatcgtcgtaattcgcgtcgcggcaaatagcggtgatttcatccggcgtggtgcccagcggtttcaacaccagtttgcagggcagtttcgcttccgtattcagcgcattaacgacgtgctcggcatgttgggtgacctgacgcagggtttccgggccatacagatgctggctgccaatgacaaaccacacttcataattatcaaaaatcgtcattatcgtgtccttatagagtcgcaacggcctgggcagcctgtgccggggcggaagttggaagatagtgttgttcggcgctcatcgcccattgctgatagcggcgataaagctgttcaaagcgttgtgcctgctcgctgcacggttgcagggttttctctaccgcactggccattttttgctgagctgatgggatgtctgcgtgcactttcgcggcgacggcagcaaaaatcgccgcaccgagcgcacagcactggtcagaggcaacaatttgcagcgggcgattcagcacgtcgcagcaggcctgcataatgacctggtttttccgcgcgatgccgcccagtgccatcacgttattaacggcgatcccctgatcggtaaagcactccatgattgcgcgtgcgccaaaggcggtggcagcaatcaaaccgccgaacagcagcggagcgtcggtagcgaggttaagatcggtaatcacccctttcaggcgttggttagcgttcggtgtgcggcggccgttaaaccagtcgagcaccaccggcaggtgatccagagacggatttttggcccatgcttcggtcagcgccggaagcagttgtttctggctggcgttgatttgcgttttcagttccggatgctgggcggcaagctgttccagcggccagccgagtacgcgaccaaaccaggcgtagatatcaccaaacgccgattggcctgcttccagaccgataaatccaggcaccacgctgccatcaacctgaccgcaaatacctttaactgcccgctcgccaacgctctgtttgtcggcaatcagaatgtcgcaggtggaagtaccgataacttttaccagtgcgttaggctgtgcgcctgcgccaactgcgcccatatggcagtcaaacgcgccgccggaaatcaccacgctttcaggcaggccgagacgctgcgcccattccgggcataaggtgcccaccggaatatcggcagtccaagtgtcagtgaacagcggggaaggcaaatggcgattgaggatcgggtccagctcatcaaagaaactggctggcggcaggccgccccagctttcgtgccacagagatttatgcccggcgctgcaacgtccgcgacgaatatcctgcgggcgggtggtaccggaaagcagagctggcacccagtcgcacagctcaatccacgatgcggcagattgcgccacggcgctgtcctggcgagtcacatgcaggatttttgcccagaaccattcgctggaataaataccaccaatgtagcgggagtagtcaacgttgcccggcgcgtggcacaaacgggtaatctcttccgcttcttcaaccgcagtgtggtctttccacaatacgaacatcgcgttcgggttttcggcaaactccgggcgcagcgccagcacgtttccgtcggcatcaatcggtgcgggcgtcgagccggtactgtcaacgccaatcccgaccacagctgcgcgctgttcgacgctaagctctgcaagcacggttttcagtgccgcttccattgactcaatgtagtcacgcggatgatgacggaactggttattcggggcatcacaaaattgccctttctgccaacggggataccactctacgctggtggcgatctcttcaccggtagcgcagtccaccgccaaagctcgcacagaatcactgccaaaatcgaggccaattgcaatcgccatcgtttcactccatccaaaaaaacgggtatggagaaacagtagagagttgcgataaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggttgggttagcgagaagagccagtaaaagacgcagtgacggcaatgtctgatgcaatatggacaattggtttcttctctgaatggtgggagtatgaaaagtatggctgaagcgcaaaatgatcccctgctgccgggatactcgtttaacgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtctgccgaccgggtgatattttgctgttcccgccaggagagattcatcactacggtcgtcatccggaggctcgcgaatggtatcaccagtgggtttactttcgtccgcgcgcctactggcatgaatggcttaactggccgtcaatatttgccaatacgggtttctttcgcccggatgaagcgcaccagccgcatttcagcgacctgtttgggcaaatcattaacgccgggcaaggggaagggcgctattcggagctgctggcgataaatctgcttgagcaattgttactgcggcgcatggaagcgattaacgagtcgctccatccaccgatggataatcgggtacgcgaggcttgtcagtacatcagcgatcacctggcagacagcaattttgatatcgccagcgtcgcacagcatgtttgcttgtcgccgtcgcgtctgtcacatcttttccgccagcagttagggattagcgtcttaagctggcgcgaggaccaacgcattagtcaggcgaagctgcttttgagcactacccggatgcctatcgccaccgtcggtcgcaatgttggttttgacgatcaactctatttctcgcgagtatttaaaaaatgcaccggggccagcccgagcgagtttcgtgccggttgtgaagaaaaagtgaatgatgtagccgtcaagttgtcataattggtaacgaatcagacaattgacggcttgacggagtagcatagggtttgcagaatccctgcttcgtccatttgacaggcacattatgcaagcattgctggaacactttattacccaatccaccgtgtattcattgatggcggtggtgttggtggcctttctggagtcgctggcgctggtcggtttgattctacccggtacggtgctgatggcggggctgggagcgctgattggcagcggcgagttaagtttctggcacgcctggctggcagggattattggctgcttgatgggcgactggatttctttctggctgggttggcgttttaaaaagccgttgcatcgctggtcatttctgaagaaaaacaaagcactacttgataaaactgaacatgcgttgcatcaacacagcatgttcaccattctggtcggtcgttttgttggcccgacgcgtccgctggtgccaatggtggcgggaatgctggatctgccggtggctaaatttattacgccgaatattatcggctgcctgctgtggccgccgttttacttcctgccagggattctggcgggcgcggcgatcgatattcctgccggaatgcagagcggtgagtttaaatggttgctgctggcaacagcggtgtttttgtgggttggtggctggctgtgctggcggttatggcgcagcggtaaagcgactgaccgtttgagtcattatttgtcccgcggtcgtttgttgtggctgacgccgttgatttctgccatcggcgtggtggcgctggtggtgttaattcgccacccgttgatgccggtgtatatcgatattttgcgtaaagtggttggggtttaggagatagtcttgtgcgggttgcctgatgcgacgcttgccgcgtcttatcaggcctacaaaacgcactacccgtaggtcggataaggcgttcacgccgcatccgacagtgcatactaacccgtaatccccaatagtgccgaagcactcgccttaccgctcaacaactcattggtcataccctgccaggcgatgcgcccgtcggcgactactaccgagcgcgtggcgatccgcgccgcatcttccacgctgtgcgacaccatcaatagcgtcattttttgctgctggcagctcgtgctcaccagcgtcaacatctcctgacgtaacgccggatcgagcgcagagaacggttcatcgagcaataaaatcggctgttcgcgtaccagacaacgcgctaacgccactcgctgtcgctgaccgccggaaagctcgcccggtaaccgcgccattaaattatcaatccccatctggcgggcgatagcgtgcattttcccctgctgtaccgcgttcagtttcaatcccggatttagccccagcccgatgttctgtgcgaccgtcaggtggctgaacaggttgttctcctgaaacagcatcgacaccggacggcgtgacggcggcatagttgtgtgatctacgccatcgatagtcagcgaaccgctggctggcgtcagaaaaccggcgatcaaattcagcagggtacttttacccgcgccgcttggcccgaggatcgccacctgctcgccgcgttccaccgttaagctaaaacgcatcggcaaatggtggtaaagccaggtgatatcagtcagttttaacatttcgccccggtagtttttcaatcacggtaaacagcagaaaacagagcagcagcagaattaacgcggtgaccgcaccgtcctggctgcgataggagccaatttgctggtagagataaaacggcagggtgcggaaatcatcgttaccgaacaacgccaccacgccaaaatcaccaatcgacagcacgcatgcaaaggccagcgcctgcgccagtggacgtttcagggcgcgcagctccaccacttttaagcgtgaccagccttcaatccccagcgactgacataacatgctgtagcgggcggtgatatcgcgcatcgggttttccagcactttcagcgcataagggatcgccattaacgcattggtgaaaatcacaatgccgtcagcagattgtggcaggccgatagtgttgttgagcagtaaaaagaagccggtagccagcacaatccccggcatggcgaggatcaacatgccgctcatctccagcacctgacccgccagcattttctgccgcgcccgcagttcgcgactgctccatagcagcatcatggtcagcactacgcacaatacacctgccgccagcgcaatacgcaacgaggtccacagcgcctgccacagcaccggttgtgccagcacttccggcaactggcgatttaccccatcgacgatcaccgccagtaacggtggcagcaacagcagcagcgccagcacaattaacaccgtgtcgcaaatgcggctatgcagacgatcgtccgggtcgcgccagccttgcagcagcgtggtgccgggcgcaatggccttactcaatcgctgactcaacagcaccagcccgaggcagcacaccatctggagcagcgccagcattgccgcgcgggcaggatcgtagtcgtaactcagcgcctgatagattgccagctcgatagtggtcgcctgcggaccgccccccagcgatagcacggtggcgaagctggcgaaacagagcataaagataagcgcagcaaccggcgggatttgtcgccgtaaccacggccattcgacgaagcggaaaaaatgccagctacgcatcccaagctgggcggcaagttgacgctgttcgccggggatgttttccagtgcctggagtaataagcggctcgccatcggcagattaaaaaacacatgggccagcaaaataccttgcaggccgtagggcgaaaaggtccactccagaccgagcgattggcagagtgttgccagccagccctggcgaccatagacgctaagaatgccgaaaacagcgaccaacaccgggaggatcaaggtcattgcacacagacgcaacagcgccagccgacccggaaagcgcctgcgatagagcgcgcgggcgaggaatatcgcgggtatgacagagagcagtgccgagagaaacgcctgccagaaggagaagcgcaccacatgccacagatagctgtcctgccagactgccacccagtcatcctgcggcgcgttccaccacagggcgagaaacgccgccagcgcaaccgctaccaccagcgtggtggcgcttacacctggaattaaccagccgggaattaacggctgacggcgcgttgccattcgctaatccatgcctgacgttgtgccgccacttcggctggcgtgaactccaacgtggttgcgggtttggtcaatttttcaaaaccggcaggcagcgtgacgtttgccaccggatacatccagttgccggttgggatcgcattctggaaagccggagaaaccataaactggaggaatttttgcgccagctccggctgcttgctggcagcggtgcgggcggcgacttccacttgcagatagtgaccttcgctgaagttcgcggcggcgtagttatctttcttctcttcgagaatgtgataagccggagaggtggtgtaactcagtaccagatcgctttcaccttttaaaaacaggccgtaggcttcgctccagcctttggtgaccgtgaccgttttcttcgccagtttctgccaggcttgtggggcgtcatcgccatagactttttgcatccatagcaacagacccagccccggtgtactggtgcgcggatcctgataaatcacccgccagttttgatcgctctcaaccagttctttcaggctttgtggcgggtttttcagtttgttcttgtcataaacgaaggcgaagtagccataatcaaacggtacgaaagtgtcattattccagccgccgggaacgttaacggcatccgctgccacaccgcttttggcaaacagtccggttttactggcggcgtctaacaggttgttatccagccccagcaccacatcggctttactgtttttgccttccatccgtagacggttgagaagcgaaacgccatcttccagcgccaccagtttcagttcgcaattacagtcggcttcaaaggcttttttaaccaccggaccaggcccccagtcggcggcgaaggaatcgtaggtataaacagtcagaacgggtttagcgaaaacgggcgctgtgcacagcaacagcaggggcagacatttttttaacactttgcacctcaaaaaagagtggcaaaggacttgagaaggagcctcaaatcccttcgccggcgttatccggatcaggttcgacgggtattttctcagcgcacgcgtacgcgtggcaccccgttgagaacggcgttagtgtagtgattttgttatcaaccagcaatcatggatccggtggcgcaaaccacgctgatttaaaatcgaaccagccgagggtattcatgcgcaggccgcgcatactgcgttgcccctgaatgatcagccagtggtgcaataatggcaccatcgctttgctggcgaccagttgctggcaccagttcgccagattcatctcgccattgcgccagcgagcagcgtcggcttgccagtcaatgggaatgcaatgttgtagcagtggcacttcgcataaatgtgcgaaaacagagaagtccagcggcagggtaaagttggcgctgtttagccagatatcactttcgatctctcctgtatgccactgatcgtagtcgatctctttgattttcagcgtgacctggtgacttgccagaatctgctgcatgatcccggcaatcacccgatgctcactgtgatcctgataaaaggttagggtgaggctttccaggccagccggtttttcgctctttatggtgcgggcatggtgccaacgggggagcagtccataagccgggaaccacagttgctggtactgttcctcagcgaaatagaccagattagttggagaaagcacatagcttacccagtccctgacttgctgattcgccccgcgatgggtgcggctgtcgaacagtaaatagtagcaaccttcctccaggcggctttcaatctctttttcctcgccctgtggaccttttagcatcagccctccggctggctcgtcggcaatttccggcagaacccagacgttaacttcgtcgattaatgcccggtaaccgaagaagtcatcgaatgcctgaattttcagttgattggtgctgttgcgaatcaccgcatacggaccggtgccgatgggatggctggcaaagttactgagggtttcccattcgcgcggcaggatcatcgccggaacttgccccagcagtaacggtaaccagcggtccggttgcgtgagatggatatccagcgtccagggcgtcggcgacacaatgtcagcaatatgcgaatagagcggcagcgtattgattcgttttaaagaggcgatcacatcgtccatttccagttcacgaccatggtgaaaatggactcctggacgcaaaaagaaacgccagtgaagcggtgaaatttgctgccagtggtgggcgatgtctgcttccagttccccattttcctcatttatgcgcgttagcgaactgaagatttgccgggcgatatgggtttcggaacggcgcaatgcgctgccaggtagcagattacgcaacggacgatagtagagcacgcgcaggatgtgccgcccctggcggaagctgcggcccagatgagaaaccagcatttgccgcacagtcgctttgtcgccaaccaactgcaccagttgatcgatacgatcctgctccagcaggtcttccgcccgctgttgctgaagcgccagcccggtatagaggaatgtcagacgcgagcgtttaccgcgcccgacttccgcttcccacgtcagccagccgcgatcctgcatggtgttgagcagggtgcgcatatgacgacgcgagcagctcaataacgctgccagttcgttgagcgttgtgtcctgcgatttaccctcgcagcattgccacaggcggatgaactgttgttgcagacgagcagatggcataaaaggggaactcctgtgcaaaagacagcaattttattttccctatattaagtcaataattcctaacgatgaagcaagggggtgccccatgcgtcagttttatcagcactattttaccgcgacagcgaagttgtgctggttgcgttggttaagcgtcccacaacgattaaccatgcttgaaggactgatgcagtgggatgaccgcaattctgaaagttgacttgcctgcatcatgtgtgactgagtattggtgtaaaatcacccgccagcagattatacctgctggttttttttattctcgccgcgctaaaaagggaacgtatgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggcctcttttatacggtgaatgctattgctgggatcggcgtaagcctctggttggcaaaacgttctgacagtcagggcgatcggcgaaaactgattatattttgctgtttgatggctatcggcaatgcgctattgtttgcatttaatcgtcattatctgacgcttatcacctgtggtgtgcttctggcatctctggccaatacggcaatgccacagttatttgctctggcgcgggaatatgcggataactcggcgcgagaagtggtgatgtttagctcggtgatgcgtgcgcagctttctctggcatgggttatcggtccaccgttggcctttatgctggcgttgaattacggctttacggtgatgttttcgattgccgccgggatattcacactcagtctggtattgattgcatttatgcttccgtctgtggcgcgggtagaactgccgtcggaaaatgctttatcaatgcaaggtggctggcaggatagtaacgtacggatgttatttgtcgcctcgacgttaatgtggacctgcaacaccatgtacattattgatatgccgttgtggatcagtagcgagttaggattgccagacaaactggcgggtttcctgatggggacggcagctggactggaaataccagcaatgattctggctggctactatgtcaaacgttatggtaagcggcgaatgatggtcatagcagtggcggcaggagtactgttttacaccggattgattttctttaatagccgtatggcgttgatgacgctgcaactttttaacgctgtatttatcggcattgttgcgggtattgggatgctatggtttcaggatttaatgcctggaagagcgggggcagctaccaccttatttactaacagtatttctaccggggtaattctggctggcgttattcagggagcaattgcacaaagttgggggcactttgctgtctactgggtaattgcggttatttctgttgtcgcattatttttaaccgcaaaggttaaagacgtttgatgacgtggacgatagcggaaagcccggtcatttgaccgggcaaggggattaattcataaacgcaggttgttttgcttcataagcggcaatggcgtcgtcgtgctgcaaggtaagcccaatactgtccagaccgttcatcatgcagtggcggcggaaggcatcgatggtaaagcgataggttttctctcccgctttcacctcttgcgcttccagatccacgtcgaaatggatccccggattagctttcaccagcgcaaacagttcgtccacttctgcatcgcttaatttcaccggcagcagctggttgttaaagctattgccgtagaagatgtcagcaaaactcggcgcaatcaccactttaaaaccgtagtcggtcaatgcccagggcgcgtgctcacgcgaagagccacagccgaagttttctcgtgccagcaaaatggaagcgccctgatactgcgggaagttcagcacgaagtccgggtttggctgttggcctttttcatccagaaaacgccagtcgttaaacagatgcgcgccaaaacccgtacgggtcactttctgcaaaaactgtttcgggatgattgcatcggtatcgacattggcggcatccagcggaaccaccaggcctgtgtgtttgataaatttctctgccatggtgtgctccttatttaatgttgcgaatgtcggcgaaatgtccggtcacagcagcagcggcagccattgccgggctgaccagatgcgtgcgcccgccgcgcccctggcggccttcaaagttacggttgctggtggaggcacaacgttcgcccggattcagacggtcgttgttcatcgccagacacattgagcagccaggcaagcgccattcaaaaccggcttcaataaagattttatccagaccttccgcttccgcctgggcttttaccgggccagagccgggaaccaccagtgcctgcacgcctggcgcgacttttcgccctttggcgatctccgctgccgcgcgtaaatcttcaatgcgcgagttggtacaggaaccgataaacactttgtcgatagccacttcggtcagcggaatacccggtttcagccccatataggccagcgctttttctgccgacgcgcgttcaaccggatcggcaaacgaagccggatcgggaatattgtcgttcacggaaatcacctggccgggattggtgccccaggtgacctgcggtgaaatttcttctgcttgcagagtgacaacggtatcgaaagttgcgccttcgtcggtttgcagggttttccagtaggcaacggcgtcgtcgaaatctttgcctttcggcgcatgcagacggcctttgacatagttaaaggtggtttcgtccggtgcaaccagaccggcttttgcgcccatttcgattgccatattgcacagggtcatacgaccttccatgcttaaatcacggattgcttcgccgcaaaactccaccacatgcccggtgccgcctgcgctaccggttttaccgataattgccagcacgatatcttttgcggtaatgcccggcgcggctttgccctggacttcaattttcatggtttttgcgcggccctgtttcagggtttgcgttgccagtacgtgttcaacttcggaagtgccgataccaaaggccagtgcgccaaacgcgccgtgggtggcggtatgcgagtcgccgcagacaatggtcatccccggcaaggtgacgccctgttccggccccattacgtggacgatcccctgatacgggtgattcaggtcatacagttcgacgccaaattctttgcagtttttgatcagttcctgcatctggatacgcgccatttcaccgcaggcattaatgtctttggtctgggtagagacgttgtgatccatggtagcgaaggttttgcccggctgacgtaccgggcgaccgtgggcgcgcagaccatcgaacgcctgcggtgaggtcacttcatgcaccaggtggcggtcgatatataacagtggggtttcgttttcggcttcgtacacaacgtgagcgtcgaacaatttttcgtataacgtcttagccatgattacaccccttctgctacatagcgggcaatgatatcgcccatttcatcggtactaacggcggcagcgccacgggctaaatccccggtgcgaatgccttcttctaatgcgcggttaatggcgcgttcaatggcgcaagccgcatcatcggcatccaggctgtaacgcagcagcagtgccagcgaaaggatttgtgcaatcgggttggcgatgtttttgcctgcgatatctggtgccgagccgcccgccggttcatacagtccaaaaccttgctcgttcaggctggcggaaggcaacatccccatcgagccagtgatcattgcgcactcgtcagacagaatgtcgccaaacaggttggagcacagcagaacgtcaaactgtgatggatctttaatcagctgcatggtggcgttgtcgatgtacatatgcgccagttcgacatccgggtattccgtggcgatctcgttaacgatctcccgccataaaatagaggattgcagcacgttggctttatcgatcgacgtcactttgtggcgacgcttgcgagcagattcaaacgcgatgcgggcgatacgttcgatctcaaaacggtgatacacctcggtatcaaaggctttttcatattgtccgctaccttcgcggccttttggctgaccgaaatagatgccgccggtcagttcgcgcacacacaggatgtcgaagccgtttgcggcaatgtctgcacgcagcggacagaatgcttccagcccctgatacagttttgccgggcgcaggttgctgaataatttgaagtgcttacgcagaggcagcagcgcgccgcgttctggttgctggtctggtggtaaatgttcccacttcgggccgcctaccgagccaaacagcacggcatcggcttgctcacaaccttcaaccgtcgcaggcggcagtggttgcccgtggttatcaatggctgcgccgcctacatcgtaatggctggtggtgatgcgcatcgcaaagcggttgcgcacggcatccagcactttcagcgcctgggtcatcacttccggaccaataccgtcccccggcaatacggcaatatggtaattcttcgacatcacacggtttccttgttgttttcgttgtgttgagctttgcgttgcaactctttttcgacttctgcggcacgccagatattgttcagaacgtgcaccatggctttggcagatgactcgacaatatcggtagccaggccgacgccgtggaagcggcgaccgttgtagttagcgacgatatccacctgacccagcgcatctttaccgtggcctttggcggtcaggctgtatttcaccagttcgacgttatattcagtgatgcggttaattgcctgatagacggcatcgaccggaccgttaccgttggcggcttctgctttgacttcttcgccacaggccagtttgacggcggcggtggcgatatcgttagagccagactgcacgctgaagtaatccagacggaaatgctccggctcttcttgctgcttaccgatgaaggccagcgcctccagatcgtaatcaaacacctgaccttttttgtccgccagcttcaggaaagcatcgtacaaattgtctaaattatattcactttctttataccccatctcatccatgcgatgtttcaccgccgcacgccccgaacgagaggtcagattcagctggatttggttcagaccaatagattctggtgtcatgatttcgtagttttcgcggtttttcagcacgccatcctggtgtataccggaggagtgtgcgaatgcgccgctgccaacaatggctttgtttgccgggatcggcatattacaaatctggctaactaactggctggtgcgccatatctcctggtgattaatggcggtgtggacgttgagaatatccttacgaactttgatcgccatgatgacttcttccagggaacagtttccggcacgctcgccgatcccgttcattgcgccttccacctggcgtgcaccggcatgtaccgccgccagtgagtttccgaccgccaggcccaaatcgtcgtgggtatgtacggagataatggctttgtcgatgttaggcacgcgttcatacaggccgctgatgattccggcgaactcaaacggcatggtgtagcccacggtgtccggaatgttgatggtggtggcaccggcattaatcgccgcttcgaccactcgcgccagatcggcaatgggtgtacgcccggcatcttcgcaagaaaattcaacatcatcggtgtaattacgggcgcgtttcaccatatagatagcgcgttcgatcacctcgtccagcgtgctgcgcagcttggtggcgatgtgcattggcgaagtggcaataaaggtatgaatacggaaggcttcggcgactttcagggattcggccgccacgtcgatatctttttccacgcagcgagctaacgcacatacgcggctgtttttaacctggcgggcgatggtttgcaccgattcaaaatcgcccggcgaagagacggggaaaccgacttccatcacgtcaacacccatacgctcaagggccagcgcaatttgcagtttttctttcacactcaagcttgcctgtaacgcctgttcaccgtcgcgcaatgtggtatcgaaaataatgacttgctggctcatggtttgggtccttgtctcttttagagcgcctcgcttcgggcataaaaaaacccgcgcaatggcgcgggttttttgtttgactgcgtgctggcttaatgctggatgccgctcactcgtctaccgcgcaaagaagatgcgtttagtagtagtagaccgataaagcgaacgatgtgagtcattaaatcagctccagatgaatgcgatatgcttttagagttactggatacaaaaacggatgtcaaccctgacgcaataaaaacgtcccgccagcgtgagttctgcatccgtaaaattagctaattgtgctgcggtggttaaagtaagcgatattaatttctgcttaactaccgacgcttttcatcggttgacatatttcagcataaatttttgcatctaatcaacgaggaaaaaggggacaaaatgcacgcgttgcaaaacctatcctgatgatttgtattgaattatatgttttgcgattttttttgatattgatttggtgaatattattgatcaattaatgttaagaattaatgcattaaatatataaattaattattaaataagcacatttaatccattttgtagatgattgagtattcgcggtagttatgattagattgttttcgcaacaaaaacattatggattattatgctgtggtaaatgactcattccacggcaatggattctgtttttatcagaacccgtatctttatgttttccgaattttactcattttgctttttcttattttatatgcatgataaatcatattcttcaggattatttctctgcattccaataagggaaagggagttaagtgtgacagtggagttaagtatgccagaggtacaaacagatcatccagagacggcggagttaagcaaaccacagctacgcatggtcgatctcaacttattaaccgttttcgatgccgtgatgcaggagcaaaacattactcgtgccgctcatgttctgggaatgtcgcaacctgcggtcagtaacgctgttgcacgcctgaaggtgatgtttaatgacgagctttttgttcgttatggccgtggtattcaaccgactgctcgcgcatttcaactttttggttcagttcgtcaggcattgcaactagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctgcgttatcaggaaacggagtttgtgattagttatgaagacttccatcgtcctgaatttaccagcgtaccattatttaaagatgaaatggtgctggtagccagcaaaaatcatccaacaattaagggcccgttactgaaacatgatgtttataacgaacaacatgcggcggtttcgctcgatcgtttcgcgtcatttagtcaaccttggtatgacacggtagataagcaagccagtatcgcgtatcagggcatggcaatgatgagcgtacttagcgtggtgtcgcaaacgcatttggtcgctattgcgccgcgttggctggctgaagagttcgctgaatccttagaattacaggtattaccgctgccgttaaaacaaaacagcagaacctgttatctctcctggcatgaagctgccgggcgcgataaaggccatcagtggatggaagagcaattagtctcaatttgcaaacgctaactgattgcagaataggtcagacatgaatgtctggtttattctgcattttttattgaatgtagaattttattctgaatgtgtgggctctctattttaggattaattaaaaaaatagagaaattgctgtaagttgtgggattcagccgatttattatcaatttaatcctctgtaatggaggattttatcgtttcttttcacctttcctcctgtttattcttattaccccgtgtttatgtctctggctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcccggaggcgcagtccttgatatttatgatgcattgcataccgtgggtggtattgatcatgtattagttcgtcatgagcaggcggcggtgcatatggccgatggcctggcgcgcgcgaccggggaagtcggcgtcgtgctggtaacgtcgggtccaggggcgaccaatgcgattactggcatcgccaccgcttatatggattccattccattagttgtcctttccgggcaggtagcgacctcgttgataggttacgatgcctttcaggagtgcgacatggtggggatttcgcgaccggtggttaaacacagttttctggttaagcaaacggaagacattccgcaggtgctgaaaaaggctttctggctggcggcaagtggtcgcccaggaccagtagtcgttgatttaccgaaagatattcttaatccggcgaacaaattaccctatgtctggccggagtcggtcagtatgcgttcttacaatcccactactaccggacataaagggcaaattaagcgtgctctgcaaacgctggtagcggcaaaaaaaccggttgtctacgtaggcggtggggcaatcacggcgggctgccatcagcagttgaaagaaacggtggaggcgttgaatctgcccgttgtttgctcattgatggggctgggggcgtttccggcaacgcatcgtcaggcactgggcatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaggtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcacgatgggttttggtttacctgcggcactgggcgtcaaaatggcgttgccagaagaaaccgtggtttgcgtcactggcgacggcagtattcagatgaacatccaggaactgtctaccgcgttgcaatacgagttgcccgtactggtggtgaatctcaataaccgctatctggggatggtgaagcagtggcaggacatgatctattccggccgtcattcacaatcttatatgcaatcgctacccgatttcgtccgtctggcggaagcctatgggcatgtcgggatccagatttctcatccgcatgagctggaaagcaaacttagcgaggcgctggaacaggtgcgcaataatcgcctggtgtttgttgatgttaccgtcgatggcagcgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtacttgagcagatcgaaaagcaattacacaaactggtcgatgtcttgcgcgtgagtgagttggggcagggcgcgcatgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcggtaagcttgatgcatttttagcatcgattcgcgatgtggcgaaaattgtggaggttgctcgctctggtgtggtcggactttcgcgcggcgataaaataatgcgttgagaatgatctcaatgcgcaatttacagcccaacatgtcacgttgggctttttttgcgaaatcagtgggaacctggaataaaagcagttgccgcagttaattttctgcgcttagatgttaatgaatttaacccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgaacgccaggcgcggcaacggggttatcaactgctgattgcctgctcagaagatcagccagacaacgaaatgcggtgcattgagcaccttttacagcgtcaggttgatgccattattgtttcgacgtcgttgcctcctgagcatcctttttatcaacgctgggctaacgacccgttcccgattgtcgcgctggaccgcgccctcgatcgtgaacacttcaccagcgtggttggtgccgatcaggatgatgccgaaatgctggcggaagagttacgtaagtttcccgccgagacggtgctttatcttggtgcgctaccggagctttctgtcagcttcctgcgtgaacaaggtttccgtactgcctggaaagatgatccgcgcgaagtgcatttcctgtatgccaacagctatgagcgggaggcggctgcccagttattcgaaaaatggctggaaacgcatccgatgccgcaggcgctgttcacaacgtcgtttgcgttgttgcaaggagtgatggatgtcacgctgcgtcgcgacggcaaactgccttctgacctggcaattgccacctttggcgataacgaactgctcgacttcttacagtgtccggtgctggcagtggctcaacgtcaccgcgatgtcgcagagcgtgtgctggagattgtcctggcaagcctggacgaaccgcgtaagccaaaacctggtttaacgcgcattaaacgtaatctctatcgccgcggcgtgctcagccgtagctaagccgcgaacaaaaatacgcgccaggtgaatttccctctggcgcgtagagtacgggactggacatcaatatgcttaaagtaaataagactattcctgactattattgataaatgcttttaaacccgcccgttaattaactcaccagctgaaattcacaataattaagtgatatcgacagcgcgtttttgcattattttgttacatgcggcgatgaattgccgatttaacaaacacttttctttgcttttgcgcaaacccgctggcatcaagcgccacacagacgtaacaaggactgttaaccggggaagatatgtcctaaaatgccgctcgcgtcgcaaactgacactttatatttgctgtggaaaatagtgagtcattttaaaacggtgatgacgatgagggattttttcttacagctattcataacgttaatttgcttcgcacgttggacgtaaaataaacaacgctgatattagccgtaaacatcgggttttttacctcggtatgccttgtgactggcttgacaagcttttcctcagctccgtaaactcctttcagtgggaaattgtggggcaaagtgggaataaggggtgaggctggcatgttccggggagcaacgttagtcaatctcgacagcaaagggcgcttatcagtgcctacccgttatcgggaacagctgcttgagaacgctgccggtcaaatggtttgcaccattgacatttatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataaaatgatggaaaactataaacatactacggtgctgctggatgaagccgttaatggcctcaatatccgtcctgatggcatctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgaacgtggcttttcctttatgcgcgatggtccgctggacatgcgtatggacccaacccgtgggcagtcagccgctgaatggctacaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgctgcaacgccggtgaaagataagtttaaacatcccgcgacccgtaccttccaggcggtgcgcatttgggtaaacagtgaactggaggagatagagcaggcgctaaaaagctcgctcaacgtgctggccccgggtgggcggctttcgatcatcagcttccactcgctggaagaccgtattgtgaaacgttttatgcgtgaaaacagccgcggtccgcaagttccggcagggttaccgatgactgaagagcagctcaaaaaactgggtggccgtcagctgcgagcactaggcaagttaatgccgggcgaagaagaggtggctgagaaccctcgtgcccgtagttcagttctgcgtattgcagagaggacgaatgcatgatcagcagagtgacagaagctctaagcaaagttaaaggatcgatgggaagccacgagcgccatgcattgcctggtgttatcggtgacgatcttttgcgatttgggaagctgccactctgcctgttcatttgcattattttgacggcggtgactgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaaggatcgccacggaaaagctgcaaatgcagcatgttgatccgtcacaagaaaatatcgtagtgcaaaaataaggataaacgcgacgcatgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagcgtgccggtaaaagcgatttgggctgacccgaaagaagtgcatgacgctggcggtatcagcgtcggtgaccgctggaaggcgctggctaacgcgctcaatattccgctggatcagctttcagcccgcattaacgccaacccgaaagggcgctttatttatctggcgcgtcaggtgaaccctgacatggcggactacatcaaaaaactgaaactgccggggattcatctgcgtgaagagtctcgccgttactatccgtccggcgaagtgactgctcacctcatcggctttactaacgtcgatagtcaagggattgagggcgttgagaagagtttcgataaatggcttaccgggcagccgggtgagcgcattgtgcgtaaagaccgctatggtcgcgtaattgaagatatttcttctactgacagccaggcagcgcacaacctggcgctgagtattgatgaacgcctgcaggcgctggtttatcgcgaactgaacaacgcggtggcctttaacaaggctgaatctggtagcgccgtgctggtggatgtcaacaccggtgaagtgctggcgatggctaacagcccgtcatacaaccctaacaatctgagcggcacgccgaaagaggcgatgcgtaaccgtaccatcaccgacgtgtttgaaccgggctcaacggttaaaccgatggtggtaatgaccgcgttgcaacgtggcgtggtgcgggaaaactcggtactcaataccattccttatcgaattaacggccacgaaatcaaagacgtggcacgctacagcgaattaaccctgaccggggtattacagaagtcgagtaacgtcggtgtttccaagctggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccattacagttagcgcgagtctacgcaactatcggcagctacggcatttatcgcccactgtcgattaccaaagttgaccccccggttcccggtgaacgtgtcttcccggaatccattgtccgcactgtggtgcatatgatggaaagcgtggcgctaccaggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgaggggacaggtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgatggtgaaatccgtgaaatgcacggcgtaccggtcatctatctcagccagctcaacgagcgtttatctgcactggcgggccgcttttaccatgaaccctctgacaatttacgtctcgtgggcgtaacgggcaccaacggcaaaaccacgactacccagctgttggcgcagtggagccaactgcttggcgaaatcagcgcggtaatgggcaccgttggtaacggcctgctggggaaagtgatcccgacagaaaatacaaccggttcggcagtcgatgttcagcatgagctggcggggctggtggatcagggcgcgacgttttgcgcaatggaagtttcctcccacgggctggtacagcaccgtgtggcggcattgaaatttgcggcgtcggtctttaccaacttaagccgcgatcaccttgattatcatggtgatatggaacactacgaagccgcgaaatggctgctttattctgagcatcattgcggtcaggcgattattaacgccgacgatgaagtgggccgccgctggctggcaaaactgccggacgcggttgcggtatcaatggaagatcatattaatccgaactgtcacggacgctggttgaaagcgaccgaagtgaactatcacgacagcggtgcgacgattcgctttagctcaagttggggcgatggcgaaattgaaagccatctgatgggcgcttttaacgtcagcaacctgctgctcgcgctggcgacactgttggcactcggctatccactggctgatctgctgaaaaccgccgcgcgtctgcaaccggtttgcggacgtatggaagtgttcactgcgccaggcaaaccgacggtggtggtggattacgcgcatacgccggatgcactggaaaaagccttacaggcggcgcgtctgcactgtgcgggcaagctgtggtgtgtctttggctgtggtggcgatcgcgataaaggtaagcgtccactgatgggcgcaattgccgaagagtttgctgacgtggcggtggtgacggacgataacccgcgtaccgaagaaccgcgtgccatcatcaacgatattctggcgggaatgttagatgccggacatgccaaagtgatggaaggccgtgctgaagcggtgacttgcgccgttatgcaggctaaagagaatgatgtggtactggtcgcgggcaaaggccatgaagattaccagattgttggcaatcagcgtctggactactccgatcgcgtcacggtggcgcgtctgctgggggtgattgcatgattagcgtaacccttagccaacttaccgacattctcaacggtgaactgcaaggtgcagatatcacccttgatgctgtaaccactgatacccgaaaactgacgccgggctgcctgtttgttgccctgaaaggcgaacgttttgatgcccacgattttgccgaccaggcgaaagctggcggcgcaggcgcactactggttagccgtccgctggacatcgacctgccgcagttaatcgtcaaggatacgcgtctggcgtttggtgaactggctgcatgggttcgccagcaagttccggcgcgcgtggttgctctgacggggtcctccggcaaaacctccgttaaagagatgacggcggcgattttaagccagtgcggcaacacgctttatacggcaggcaatctcaacaacgacatcggtgtaccgatgacgctgttgcgcttaacgccggaatacgattacgcagttattgaacttggcgcgaaccatcagggcgaaatagcctggactgtgagtctgactcgcccggaagctgcgctggtcaacaacctggcagcggcgcatctggaaggttttggctcgcttgcgggtgtcgcgaaagcgaaaggtgaaatctttagcggcctgccggaaaacggtatcgccattatgaacgccgacaacaacgactggctgaactggcagagcgtaattggctcacgcaaagtgtggcgtttctcacccaatgccgccaacagcgatttcaccgccaccaatatccatgtgacctcgcacggtacggaatttaccctacaaaccccaaccggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccatccaactggcagaaaaccagttgctgctcgacgactcctacaacgccaatgtcggttcaatgactgcagcagtccaggtactggctgaaatgccgggctaccgcgtgctggtggtgggcgatatggcggaactgggcgctgaaagcgaagcctgccatgtacaggtgggcgaggcggcaaaagctgctggtattgaccgcgtgttaagcgtgggtaaacaaagccatgctatcagcaccgccagcggcgttggcgaacattttgctgataaaactgcgttaattacgcgtcttaaattactgattgctgagcaacaggtaattacgattttagttaagggttcacgtagtgccgccatggaagaggtagtacgcgctttacaggagaatgggacatgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacacttcagcaagcgcggtacgccgaccatgggcgggattatgatcctgacggcgattgtgatctccgtactgctgtgggcttacccgtccaatccgtacgtctggtgcgtgttggtggtgctggtaggttacggtgttattggctttgttgatgattatcgcaaagtggtgcgtaaagacaccaaagggttgatcgctcgttggaagtatttctggatgtcggtcattgcgctgggtgtcgccttcgccctgtaccttgccggcaaagacacgcccgcaacgcagctggtggtcccattctttaaagatgtgatgccgcagctggggctgttctacattctgctggcttacttcgtcattgtgggtactggcaacgcggtaaacctgaccgatggtctcgacggcctggcaattatgccgaccgtatttgtcgccggtggttttgcgctggtggcgtgggcgaccggcaatatgaactttgccagctacttgcatataccgtatctgcgacacgccggggaactggttattgtctgtaccgcgatagtcggggcaggactgggcttcctgtggtttaacacctatccggcgcaggtctttatgggcgatgtaggttcgctggcgttaggtggtgcgttaggcattatcgccgtactgctacgtcaggaattcctgctggtgattatggggggcgtgttcgtggtagaaacgctttctgtcatcctgcaggtcggctcctttaaactgcgcggacaacgtattttccgcatggcaccgattcatcaccactatgaactgaaaggctggccggaaccgcgcgtcattgtgcgtttctggattatttcgctgatgctggttctgattggtctggcaacgctgaaggtacgttaatcatggctgattatcagggtaaaaatgtcgtcattatcggcctgggcctcaccgggctttcctgcgtggactttttcctcgctcgcggtgtgacgccgcgcgttatggatacgcgtatgacaccgcctggcctggataaattacccgaagccgtagaacgccacacgggcagtctgaatgatgaatggctgatggcggcagatctgattgtcgccagtcccggtattgcactggcgcatccatccttaagcgctgccgctgatgccggaatcgaaatcgttggcgatatcgagctgttctgtcgcgaagcacaagcaccgattgtggcgattaccggttctaacggcaaaagcacggtcaccacgctagtgggtgaaatggcgaaagcggcgggggttaacgttggtgtgggtggcaatattggcctgcctgcgttgatgctactggatgatgagtgtgaactgtacgtgctggaactgtcgagcttccagctggaaaccacctccagcttacaggcggtagcagcgaccattctgaacgtgactgaagatcatatggatcgctatccgtttggtttacaacagtatcgtgcagcaaaactgcgcatttacgaaaacgcgaaagtttgcgtggttaatgctgatgatgccttaacaatgccgattcgcggtgcggatgaacgctgcgtcagctttggcgtcaacatgggtgactatcacctgaatcatcagcagggcgaaacctggctgcgggttaaaggcgagaaagtgctgaatgtgaaagagatgaaactttccgggcagcataactacaccaatgcgctggcggcgctggcgctggcagatgctgcagggttaccgcgtgccagcagcctgaaagcgttaaccacattcactggtctgccgcatcgctttgaagttgtgctggagcataacggcgtacgttggattaacgattcgaaagcgaccaacgtcggcagtacggaagcggcgctgaatggcctgcacgtagacggcacactgcatttgttgctgggtggcgatggtaaatcggcggactttagcccactggcgcgttacctgaatggcgataacgtacgtctgtattgtttcggtcgtgacggcgcgcagctggcggcgctacgcccggaagtggcagaacaaaccgaaactatggaacaggcgatgcgcttgctggctccgcgtgttcagccgggcgatatggttctgctctccccagcctgtgccagccttgatcagttcaagaactttgaacaacgaggcaatgagtttgcccgtctggcgaaggagttaggttgatgcgtttatctctccctcgcctgaaaatgccgcgcctgccaggattcagtatcctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccatagggcaacgcttaaccaacgatccgttcttcttcgcgaagcgtgatggtgtctatctgattttggcgtttattctggcgatcattacgctgcgtctgccgatggagttctggcaacgctacagtgccacgatgctgctcggatctatcatcctgctgatgatcgtcctggtagtgggtagctcggttaaaggggcatcgcgttggatcgatctcggtttgctgcgtatccagcctgcggagctgacaaaactgtcgctgttttgctatatcgccaactatctggtgcgtaaaggcgacgaagtacgtaataacctgcgcggcttcctgaaaccgatgggcgtgattctggtgttggcagtgttactgctggcacagccagaccttggtacggtggtggtgttgtttgtgactacgctggcgatgttgttcctggcgggagcgaaattgtggcagttcattgccattatcggtatgggcatttcagcggttgtgttgctgatactcgccgaaccgtaccgtatccgccgtgttaccgcattctggaacccgtgggaagatccctttggcagcggctatcagttaacgcaatcgctgatggcgtttggtcgcggcgaactttgggggcaaggtttaggtaactcggtacaaaaactggagtatctgccggaagcgcacactgactttattttcgccattatcggcgaagaactggggtatgtcggtgtggtgctggcacttttaatggtattcttcgtcgcttttcgcgcgatgtcgattggccgtaaagcattagaaattgaccaccgtttttccggttttctcgcctgttctattggcatctggtttagcttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatgagtggtcaaggaaagcgattaatggtgatggcaggcggaaccggtggacatgtattcccgggactggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgccccgctgcgtatcttcaacgcctggcgtcaggcgcgggcgattatgaaagcgtacaaacctgacgtggtgctcggtatgggaggctacgtgtcaggtccaggtggtctggccgcgtggtcgttaggcattccggttgtacttcatgaacaaaacggtattgcgggcttaaccaataaatggctggcgaagattgccaccaaagtgatgcaggcgtttccaggtgctttccctaatgcggaagtagtgggtaacccggtgcgtaccgatgtgttggcgctgccgttgccgcagcaacgtttggctggacgtgaaggtccggttcgtgtgctggtagtgggtggttctcagggcgcacgcattcttaaccagacaatgccgcaggttgctgcgaaactgggtgattcagtcactatctggcatcagagcggcaaaggttcgcaacaatccgttgaacaggcgtatgccgaagcggggcaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgccagcaatactggaatgcgctaccgctggaaaaagcgggcgcagccaaaattatcgagcagccacagcttagcgtggatgctgtcgccaacaccctggccgggtggtcgcgagaaaccttattaaccatggcagaacgcgcccgcgctgcatccattccggatgccaccgagcgagtggcaaatgaagtgagccgggttgcccgggcgtaattgtagcgatgccttttgcatcgtatgaatttaagaagttaatggcgtaaagaatgaatacacaacaattggcaaaactgcgttccatcgtgcccgaaatgcgtcgcgttcggcacatacattttgtcggcattggtggtgccggtatgggcggtattgccgaagttctggccaatgaaggttatcagatcagtggttccgatttagcgccaaatccggtcacgcagcagttaatgaatctgggtgcgacgatttatttcaaccatcgcccggaaaacgtacgtgatgccagcgtggtcgttgtttccagcgcgatttctgccgataacccggaaattgtcgccgctcatgaagcgcgtattccggtgatccgtcgtgccgaaatgctggctgagttaatgcgttttcgtcatggcatcgccattgccggaacgcacggcaaaacgacaaccaccgcgatggtttccagcatctacgcagaagcggggctcgacccaaccttcgttaacggcgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgatccgcgaattgttaccgcgagtggggcgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggcattgacgacgaggctattttgcgggcgcttgaaagcttccaggggactggtcgccgttttgatttcctcggtgaattcccgctggagccagtgaatggtaaaagcggtacggcaatgctggtcgatgactacggccaccacccgacggaagtggacgccaccattaaagcggcgcgcgcaggctggccggataaaaacctggtaatgctgtttcagccgcaccgttttacccgtacgcgcgacctgtatgatgatttcgccaatgtgctgacgcaggttgataccctgttgatgctggaagtgtatccggctggcgaagcgccaattccgggagcggacagccgttcgctgtgtcgcacaattcgtggacgtgggaaaattgatcccattctggtgccggatccggcgcgggtagccgagatgctggcaccggtattaaccggtaacgacctgattctcgttcagggggctggtaatattggaaaaattgcccgttctttagctgaaatcaaactgaagccgcaaactccggaggaagaacaacatgactgataaaatcgcggtcctgttgggtgggacctccgctgagcgggaagtttctctgaattctggcgcagcggtgttagccggactgcgtgaaggcggtattgacgcgtatcctgtcgacccgaaagaagtcgacgtgacgcaactgaagtcgatgggctttcagaaagtgtttatcgcgctacacggtcgcggcggtgaagatggtacgctgcaggggatgctcgagctgatgggcttgccttataccggaagcggagtgatggcatctgcgctttcaatggataaactacgcagcaaacttctatggcaaggtgccggtttaccggtcgcgccgtgggtagcgttaacccgcgcagagtttgaaaaaggcctgagcgataagcagttagcagaaatttctgctctgggtttgccggttatcgttaagccgagccgcgaaggttccagtgtgggaatgtcaaaagtagtagcagaaaatgctctacaagatgcattaagattggcatttcagcacgatgaagaagtattgattgaaaaatggctaagtgggccggagttcacggttgcgatactcggtgaagaaattttaccgtcaatacgtattcaaccgtccggaaccttctatgattatgaggcgaagtatctctctgatgagacacagtatttctgccccgcaggtctggaagcgtcacaagaggccaatttgcaggcattagtgctgaaagcatggacgacgttaggttgcaaaggatggggacgtattgacgttatgctggacagcgatggacagttttatctgctggaagccaatacctcaccgggtatgaccagccacagcctggtgccgatggcggcacgtcaggcaggtatgagcttctcgcagttggtagtacgaattctggaactggcggactaatatgtcgcaggctgctctgaacacgcgaaacagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacacgtaatgacgatatccggcagtcgatcctggcattgggtgagccgggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacatatggtagacgcggaaggaaataccttcagcgtgccgccagaacgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcggcgttcctggcagttgacgctgaataacgatattaagctcaatcttggccggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccagaggaatctactcagcaacaaaatcaggcacaggcagaacaacaatgatcaaggcgacggacagaaaactggtagtaggactggagattggtaccgcgaaggttgccgctttagtaggggaagttctgcccgacggtatggtcaatatcattggcgtgggcagctgcccgtcgcgtggtatggataaaggcggggtgaacgacctcgaatccgtggtcaagtgcgtacaacgcgccattgaccaggcagaattgatggcagattgtcagatctcttcggtatatctggcgctttctggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgctgcatgtgatcccgcaagagtatgcgattgactatcaggaagggatcaagaatccggtaggactttcgggcgtgcggatgcaggcaaaagtgcacctgatcacatgtcacaacgatatggcgaaaaacatcgtcaaagcggttgaacgttgtgggctgaaagttgaccaactgatatttgccggactggcatcaagttattcggtattgacggaagatgaacgtgaactgggtgtctgcgtcgtcgatatcggtggtggtacaatggatatcgccgtttataccggtggggcattgcgccacactaaggtaattccttatgctggcaatgtcgtgaccagtgatatcgcttacgcctttggcacgccgccaagcgacgccgaagcgattaaagttcgccacggttgtgcgctgggttccatcgttggaaaagatgagagcgtggaagtgccgagcgtaggtggtcgtccgccacggagtctgcaacgtcagacactggcagaggtgatcgagccgcgctataccgagctgctcaacctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaatttttatgaggccgacgatgattacggcctcaggcgacaggcacaaatcggagagaaactatgtttgaaccaatggaacttaccaatgacgcggtgattaaagtcatcggcgtcggcggcggcggcggtaatgctgttgaacacatggtgcgcgagcgcattgaaggtgttgaattcttcgcggtaaataccgatgcacaagcgctgcgtaaaacagcggttggacagacgattcaaatcggtagcggtatcaccaaaggactgggcgctggcgctaatccagaagttggccgcaatgcggctgatgaggatcgcgatgcattgcgtgcggcgctggaaggtgcagacatggtctttattgctgcgggtatgggtggtggtaccggtacaggtgcagcaccagtcgtcgctgaagtggcaaaagatttgggtatcctgaccgttgctgtcgtcactaagcctttcaactttgaaggcaagaagcgtatggcattcgcggagcaggggatcactgaactgtccaagcatgtggactctctgatcactatcccgaacgacaaactgctgaaagttctgggccgcggtatctccctgctggatgcgtttggcgcagcgaacgatgtactgaaaggcgctgtgcaaggtatcgctgaactgattactcgtccgggtttgatgaacgtggactttgcagacgtacgcaccgtaatgtctgagatgggctacgcaatgatgggttctggcgtggcgagcggtgaagaccgtgcggaagaagctgctgaaatggctatctcttctccgctgctggaagatatcgacctgtctggcgcgcgcggcgtgctggttaacatcacggcgggcttcgacctgcgtctggatgagttcgaaacggtaggtaacaccatccgtgcatttgcttccgacaacgcgactgtggttatcggtacttctcttgacccggatatgaatgacgagctgcgcgtaaccgttgttgcgacaggtatcggcatggacaaacgtcctgaaatcactctggtgaccaataagcaggttcagcagccagtgatggatcgctaccagcagcatgggatggctccgctgacccaggagcagaagccggttgctaaagtcgtgaatgacaatgcgccgcaaactgcgaaagagccggattatctggatatcccagcattcctgcgtaagcaagctgattaagaattgactggaatttgggtttcgaggctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtacggatttcaaccgtagagcacctcaatgctgctctcgcgggcttgggcatcgataacattgttatcgaagttaacgcgccggaaatcccgatcatggacggcagcgccgctccgtttgtatacctgctgcttgacgccggtatcgacgagttgaactgcgccaaaaaatttgttcgcatcaaagagactgttcgtgtcgaagatggcgataagtgggctgaatttaagccgtacaatggtttttcgctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatccggtcatgcactgaataacaaactgctgcaggctgtcctggcgaaacaggaagcctgggaatatgtgaccttccaggacgacgcagaactgccgttggccttcaaagcgccttcagctgtactggcataacgacatttatactgtcgtataaaattcgactggcaaatctggcactctctccggccaggtgaaccagtcgtttttttttgaattttataagagctataaaaaacggtgcgaacgctgttttcttaagcacttttccgcacaacttatcttcattcgtgctgtggactgcaggctttaatgataagatttgtgcgctaaatacgtttgaatatgatcgggatggcaataacgtgagtggaatactgacgcgctggcgacagtttggtaaacgctacttctggccgcatctcttattagggatggttgcggcgagtttaggtttgcctgcgctcagcaacgccgccgaaccaaacgcgcccgcaaaagcgacaacccgcaaccacgagccttcagccaaagttaactttggtcaattggccttgctggaagcgaacacacgccgcccgaattcgaactattccgttgattactggcatcaacatgccattcgcacggtaatccgtcatctttctttcgcaatggcaccgcaaacactgcccgttgctgaagaatctttgcctcttcaggcgcaacatcttgcattactggatacgctcagcgcgctgctgacccaggaaggcacgccgtctgaaaagggttatcgcattgattatgcgcattttaccccacaagcaaaattcagcacgcccgtctggataagccaggcgcaaggcatccgtgctggccctcaacgcctcacctaacaacaataaacctttacttcattttattaactccgcaacgcggggcgtttgagattttattatgctaatcaaattgttaactaaagttttcggtagtcgtaacgatcgcaccctgcgccggatgcgcaaagtggtcaacatcatcaatgccatggaaccggagatggaaaaactctccgacgaagaactgaaagggaaaaccgcagagtttcgtgcacgtctggaaaaaggcgaagtgctggaaaatctgatcccggaagctttcgccgtggtacgtgaggcaagtaagcgcgtctttggtatgcgtcacttcgacgttcagttactcggcggtatggttcttaacgaacgctgcatcgccgaaatgcgtaccggtgaaggaaaaaccctgaccgcaacgctgcctgcttacctgaacgcactaaccggtaaaggcgtgcacgtagttaccgtcaacgactacctggcgcaacgtgacgccgaaaacaaccgtccgctgtttgaattccttggcctgactgtcggtatcaacctgccgggcatgccagcaccggcaaagcgcgaagcttacgcagctgacatcacttacggtacgaacaacgaatacggctttgactacctgcgcgacaacatggcgttcagccctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggacgaaaaatctcgccaggtgaacctgaccgaacgtggtctggtgctgattgaagaactgctggtgaaagagggcatcatggatgaaggggagtctctgtactctccggccaacatcatgctgatgcaccacgtaacggcggcgctgcgcgctcatgcgctgtttacccgtgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgaccggtactgctgataccgaagctttcgaatttagctcaatctacaagctggataccgtcgttgttccgaccaaccgtccaatgattcgtaaagatctgccggacctggtctacatgactgaagcggaaaaaattcaggcgatcattgaagatatcaaagaacgtactgcgaaaggccagccggtgctggtgggtactatctccatcgaaaaatcggagctggtgtcaaacgaactgaccaaagccggtattaagcacaacgtcctgaacgccaaattccacgccaacgaagcggcgattgttgctcaggcaggttatccggctgcggtgactatcgcgaccaatatggcgggtcgtggtacagatattgtgctcggtggtagctggcaggcagaagttgccgcgctggaaaatccgaccgcagagcaaattgaaaaaattaaagccgactggcaggtacgtcacgatgcggtactggaagcaggtggcctgcatatcatcggtaccgagcgtcacgaatcccgtcgtatcgataaccagttgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgaacacccgtgggtgactaaagcgattgccaacgcccagcgtaaagttgaaagccgtaacttcgacattcgtaagcaactgctggaatatgatgacgtggctaacgatcagcgtcgcgccatttactcccagcgtaacgaactgttggatgtcagcgatgtgagcgaaaccattaacagcattcgtgaagatgtgttcaaagcgaccattgatgcctacattccaccacagtcgctggaagaaatgtgggatattccggggctgcaggaacgtctgaagaacgatttcgacctcgatttgccaattgccgagtggctggataaagaaccagaactgcatgaagagacgctgcgtgagcgcattctggcgcagtccatcgaagtgtatcagcgtaaagaagaagtggttggtgctgagatgatgcgtcacttcgagaaaggcgtcatgctgcaaacgcttgactccctgtggaaagagcacctggcagcgatggactatctgcgtcagggtatccacctgcgtggctacgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagccatcaggatgacgactctgcagccgcagctgcactggcggcgcaaaccggagagcgcaaagtaggacgtaacgatccttgcccgtgcggttctggtaaaaaatacaagcagtgccatggccgcctgcaataaaagctaactgttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaaattgaaatgggtgaaacgccggaacaggcggtggtgcgtgaacttcaggaagaagtcgggattaccccccaacatttttcgctatttgaaaaactggaatatgaattcccggacaggcatataacactgtggttttggctggtcgaacgctgggaaggggagccgtggggtaaagaagggcaacccggtgagtggatgtcgctggtcggtcttaatgccgatgattttccgccagccaatgaaccggtaattgcgaagcttaaacgtctgtaggtcagataaggcgttttcgccgcatccgacattcgcacacgatgcctgatgcgacgctggcgcgtcttatcaggcctaaagggatttctaactcattgataaatttgtttttgtaggtcggataaggcgttcacgccgcatccgacatttgcacaagatgcctgatgcgacgctgtccgcgtcttatcaggcctacgtgcggcatcagacaaatgtcactgctttggttcttcgctccagtcatcgctttcggaaagatcgccactgctggggattcgtttttcttcagcagcccattctccgaggtcgatcagctgacaacgtttggagcaaaatggccgaaacgggctgatttcaccccacaccaccgttttcccgcaggttgggcaattcaccgtaatagtttctgacatttttactccttagcaacaggccagttcgaaatccagacgttccggtacctgtccgttttcagtgtccagcggcataaaacgaatggcaaaacggctcttatgtccggaaatttgcggataaagctgtgaatcgagcgacagattcaggcgcagcaagtcggcatcgccaccgttatcctgataaaaaccattcaggctggtttgtttacggaagggggccgactggcgaattaaatccagcaccatggtaagtgcctgggtgagcgggttcaggctggcaatccaggtttctacctggctgtcgcgctgcgcctggggtagatgcagccaaatgtgcaatgtaggtaaatcaaagctgcaacagccgcctgggatgctcagtcgctgacgcaccagagcaatcaaacgatcttcacgcagaaattgcccgatacgcggcgcggaaattaatacgctccccgccgcttttaactgctgaattaatgcttcaatacggctctggtccacgccaggcacgccaatccaggtctggagtttacgttgctgccggtcaagttctttcaacagctcagtgcggacttcgccgcgctcgaaaacatccagtaattcactgacattacggaagaaatgcagcgcgccagcgtggtcaacgatgggtaaattaacggtgagttgctgaatcaaaaactcaatgcgcagccatgtacgcattttttcatttagtggatgttcaaaaaggacctgggtctgcattacggtttttcctgtgagacaaactgcgacgcaagctgcaaatagtgtgcgtgcaggcgggcaacatccgatgcgatagcatccggtgcgccgttattatcaatgacgtcatctgccacggcaaggcgggcttcgcgcgttgcctgagcagcaaggatttgttcgacatgctcgcgagttacatcatcgcgctgcatggtgcgcttaagttgcgtttctgggctgacatccaccacaagcactcgattcgcttttttatacagtgagttttctaccagcaatggcacaacccacagtacatagggggaagtagcttgctggatctggtgttgcgtctcttgctgaatcagcggatgcagcagggcgttaagccagtttttctcttccgggttggcgaagatccgctcgcgcaaggcccggcgctgcaatgttccatcagcagcaatcatgttagcgccaaagtgatcagcaatggcatgtagcgcaggtgcacctggttcaaccacctgacgcgcaataatatcggcatcaatgacgttaattccgagatcagcaaacgcattggcaacggtactcttgccactgccaatgcctcccgttaaggcaactatatacctcataatttatattcccgggaattcatcatgattatcaaaacgttaaaaatgagtgcacgaaagcgaaattgatgaaacgttcgctcactatttaccaggtaaatttatgggattgtagcgtaaaaaaagacaatttcgcagtcttgcgccgcattgattagtgcgtatgatagcgtcactggagttgcgctcttacccttatagccattaaccccaggaatccgcacatgcgtattgaagaagatctgaagttaggttttaaagacgttctcatccgccctaaacgctccactcttaaaagccgttccgatgttgaactggaacgtcaattcaccttcaaacattcaggtcagagctggtccggcgtgccgattatcgccgcaaatatggacaccgtaggcacattttctatggcctctgcgctggcttcttttgatattttgactgctgtgcataaacactattctgtcgaagagtggcaagcgtttatcaacaattcttccgctgatgtgctgaaacatgtgatggtttctaccggtacgtctgatgcggatttcgaaaaaactaaacagattctcgacctgaacccggcattaaacttcgtttgtattgacgtggcgaatggttattccgaacacttcgtgcagttcgttgcgaaagcgcgtgaagcgtggccgaccaaaaccatttgtgctggtaacgtagtgactggtgaaatgtgtgaggagcttatcctctcaggtgccgatatcgttaaagttggcattggcccaggttctgtttgtacaactcgcgtcaaaacaggcgtcggttatccgcaactttctgcggtaatcgaatgtgccgatgctgcgcacggtctgggcggaatgatcgtcagcgatggtggctgcaccacgccgggcgatgtggcgaaagcctttggcggcggtgccgatttcgtcatgcttggcggcatgctggcgggccacgaagagagcggcggtcgcatcgttgaggagaacggcgagaaatttatgctgttctacggcatgagctccgagtctgcgatgaaacgtcacgttggcggcgttgcggaatatcgcgcagcagaaggtaaaaccgttaagctgccgctgcgaggcccggttgaaaataccgcgcgagatattttgggcggcctgcgttcagcttgtacatacgttggggcttcacgcctgaaagagctgaccaagcgcaccacgtttattcgtgtgcaggaacaagaaaaccgcatcttcaacaacctgtaatctcccaacgctggcgtggagcaacacgccagcgttatcccatcccactcatcgcatcgcctaaatggaaaattggcagatacattgccaccaccagcgtaccaataattcctcccgttatgatcagcaacgccggttccagtaaggctgcgaggttatccgccagcgccattgtgttttcccgatgatgatgggcgaggttgtctaacatgagatccagagagccggatgcctctcctgttctcactaattgcaaacagagcgggctaaactcaccggtattttttagcgccagccagatgggttgaccgttactgatatcgtgctggatttgtgtcagaagttgcacccagtacgggcagcgcattgtttctctgacgctctctacgccctgtaaaaaagtaatgcctgcactttgtgtcagcgccagaatcgtaaagatctgcgtgagtttttgtccccgcatcagtgaacccataatcgggatgcgtaacagcaatttctgccgcactataagccaggtcggtcggcgcatcagcaacttattggctatcgccagcagaaagccgaacaacaccagcagccagctccattcgccactaaagtctgccagcgtcatgatcccctgcgttagtgccggtagtggggtgttgaaggtcttatagatagcggcaaactccggcagaacaaaatgcagcattgccacaaccaccatgattgccatcgctaaaatgatgatgggataacgtaacgctgatttcactttgtcggtcaactgacgctgggctttttgctgacgcgccagttcaaagcagcattcatccagcttaccggtcagttcacccgtgcggatcatcgcctgatagagcggcggaaatacctctgaccagggtaataaggcattggaaaaagcaatgccctgttcgagatcgtgcgccagcgattgcagcaacgcttgccattgcttactgggatgctgttccgccagcagagccagcccttcagaaagcgttaaccctgctttgagtagcgtcgccagttgatgaatgacttccgcgcttttatctcctcgccactgcgcagaattgatggcgattcgcttcaggcttagtggggtaaccatctgttgctgtagtgccataagcagtaaagtacggctctctgcccatagcatcccatcttgcgcattgccgtcgccggttatgccatgccagcgccagagttgcttactcgccatgcggcatccccagtacgcggattaactcttcaaaggtggttaagccttgctctacggccaggcagccgttttcaaaaagcgtacgcatacccgcctgtcgtgcgtgcgtttccagcgattcaacgtcggtattagcggaaataagctgacgaatgaccggcgttatgggcagaacttcaaataaggccgtacgaccataaaaaccgtggtagcaatgtacacaaccgggtgcctgccagtggggcagcggcgatggccatacattgtctggaatgtggatgggctccccttgctgccggcgacaatgtgggcaaagtttgcgtaccagacgctgggctattaccagcgtaagcgccgatgatagcatccagcgggcgacccccatttgctgtaaacgtaccagcgtttcgcaggtggaattagtgtgtagggtagacaacaccaggtgaccagtttgcgccgctttaatagcgatctctgctgtttcgccatcgcggatctctccgatcatgatgacgtcaggatcctggcgcaataacgcacgcaaaacgccctgaaaggtgagtccggcacgcggatggatttgcgtctggtttagtccggctatggggatctcaactggatcttcgacgctacaaatattaatgtcagcggtattcagcttttgcagggcactataaagcgtgaccgttttgccgctgccggtagggccagttaccagcaccagtccctgtggttgttgcaaggcatgagcaaagtccgccagttgtaacggctgcattccaagcgtgttgacatccagtgcctgacccacctgctgtaacaaccttaataccaccttttcaccaccccgacatggtaaggtcgcaatacgaaatgagacggcgtttcctgccagttcgacagtgaattgcccgtcctgcggcaggcgatgttccgcaatatccaggtttcccagcacttttaatctggcggttaatgcgactccggcatccggtgaaacatccggtaaaggatgcaatacgccgtcgatacgcaagcggatgcggtaggcattgtccgctggttcgatatgaatatcagacgcgcgttgttccagcgcagattgtaacgttcgagttagcaactctgctttgggctgatgcttctcctgaacagctacgggcaatgtctgttgtgtgcgactggcgtgaccttccatttgttggcgcgtccagcaggtgatctcaatacgtttggtggtagcgaaatgcaatgcgtccagtagctcatgcgaaggtgcatcgactaccgcaacatgaaccacctcttcgctggcatccagcaagactccatgataacgcagacacagggcagtgagctgtggaatattcattgccgctccttagttggcgtcatcaaagcggaagacatcttcgcaggcttgctgcaatgcgctgtcactttgaatattgcagttgcgcgtccagccggtgacgccgtttgcgttatcccaacccggtgtcatgacgacgcttagcccattgagactttcttgcccggtcagcgacaccacgccctttgccacactcatggctgaaacatagcgggtggtggtaggcgagggaatgccattgctgccaccgtcgcaggtatctaatccaccatgttccagcgcgcacaactctacggcggtacggtaaggcacaaaggtttgtagcatgtcggtgagtgcggctttgcgcaggtagttttgataagcgggaataccaatggcgcttaaaatggcaatgatgccaataaccaccatcagttcgataagtgtaaaaccgcgttgcttgtccatctgtttcgctccttgatttggttggcgctactttggcaaacgccatcagcacaggcgaggggcaaaaaacgaaacgggaaagcagattccgaggttttttatttcgttgcagcgaaagacaagaaatttgcgaggcgttacgaagaaagttggggaaggggagattatccgcccgcgatggagcggataaatctgtcaactattagcgaaaacgcattgaaaggtcgagtgcttgtacgtgtttagttagcgcaccgacggagataaagtccacgcccgtttcggcaaattcacgcagtgttttgtcagtgacgttgccagacacttccagtagcgccttgccgttggtgcgtttgacggcttcgcgcatctgttctgtttcgaagttatccagcatgatgatatcggctcctgctttcagggcttcatcaagttcttccagattctctacttcgacttctactggcgcatccgggtgcagccaggacgctttttcgaccgcctggcgcactgagccggaggcaataatatggttttctttgatcaggaaggcatcagaaagccccagacggtgattcgctccgccgccgcaaagtaccgcgtatttcagagctgaacgcaggccgggtaaggttttgcgcgtatccaacaactgcgtgttggtgccttccagcaattcgacatagtggcgtaccttactggcaactcctgaaagggtttgcacaaaattaagcgcagtgcgttcgcccgttaacagcacgcgggatgggccttcaagttcgaacaaggattgattggcattgatgacatcgccgtcatccacatgccagattatggtgacatcgtcgcctgccagttgaataaacacctcttcaacccagcgtttgccgcaaaagacgccattctcgcgggtgatcaccgtggcatgagagcgagaattttccggtaaaagttttgccgtaatatcattgttggcatcgactgttccgcctaaatcttcccgcagcgcctgggccaccgcgccggggatatcgagattaatgcgttccagcagctcgtcacgtcgggtgtcagggttatagcggcgaggcggcatgttaaaactccagatagctaacgaatcataaggtagaaacatgctactctgaaccgggtattagcaccacatataaggagatcctgcatgttgttagaacaggggtggctggttggcgcgcgccgcgttccctcaccacattacgattgccgcccggatgacgaaacacccaccctgctggtggtgcacaatattagcctgccgccaggcgagtttggcggtccgtggatcgacgcattattcactggaactattgatccgcaggcacatcctttctttgctgagatcgcccatttgcgcgtctccgctcactgtttgattcgccgtgatggtgaaatagtccagtatgttcctttcgataaacgtgcatggcatgcgggagtctctcagtatcaggggcgcgaacgctgcaatgatttttctattgggattgagcttgaaggcaccgatacgctggcgtataccgatgcgcagtatcaacagcttgcggcggttacgcgggcactgattgattgctatccggatatcgctaaaaacatgacgggccattgtgatattgcgccggatcggaaaaccgatcccggtcctgcatttgattgggcacggtttcgtgtgctggtcagcaaggagacaacatgacgctatttacaaccttactggtgttaattttcgagcgcctgtttaagttgggcgagcactggcagcttgatcatcgtcttgaagcgttctttcggcgggtgaaacatttttctctcgggcgcacgttaggcatgaccattattgcgatgggcgtgacttttttactgttacgcgcattgcagggagtattgttcaacgttcccacgctactggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgacgaacgtgagtatttgcgtgagctgcaaaatgcattgctgtggattaactttcgtttttatcttgcaccgctgttctggctgattgtggggggaacctggggacccgttacgctgatggggtatgcgtttttgcgtgcatggcaatactggctggcgcgatatcagacgccgcatcatcgtttacagtccggcattgatgccgtgcttcatgtactggattgggtgccggttcgtcttgcgggtgtggtatatgccttgatcggtcatggtgagaaagcgttaccggcctggtttgcttcgctgggtgatttccatacttcgcagtatcaggtgttaacgcgtctggcgcagttctctctggcgcgtgaaccgcatgtcgataaggtggagacgccgaaggcagcggtttcaatggcgaagaaaacctcgttcgtggtcgtggtggtgattgcactactgacgatttacggggcgttggtgtaaagattattgccctcaccctgtacgggtgagggcgtagagagattaatgcgcttttacggctttggcggttttctctttaaacagatagccgatacctaacacgatcagccataccgggatcaggtataccgaaatcgccattcctggggtcatcagcataatcaccagtaccgccgccataaacagcaggcagatccagttacccagcggataaagcagagcagggaagcgagttaccacgccttgttcctgcttggcgcgacggaatttcatatgcgccaggctaatcatcgcccagttgattaccagtgcagataccaccagcgccattaacagtccgaaagcggactctggggcaaggtagttaatcagtacgcacaacgccgttaccagtgcagacaccagaatggtatttactggtacaccacgtttatcgacagacgccagcgcttttggcgcattaccctgttgtgccagaccaaacagcatacggctgttgcaatatacgcagctgttgtacacggagagcgccgcagtcagtaccacgatgttcagcgcattcgccacaaaggtatcgcctaactcgtggaagatcagcacaaacggactggtatcggcggtaacgcgggtccacggcatcagtgagagcagaacggctaacgaaccaatatagaaaatcaggatgcggtagataacctggttagttgctttcggtatactttgctccgggttatcagcttctgctgcggtgatccccaccagttccagaccaccgaacgagaacatgataatcgccatcatcatcaccagcccggtgaagccgtgcggcaggaaaccaccctgatcccacaggttgctaacggtcgcctgcgggccgccgttgccactgaatagcagccagccgccgaagatgatcatcgctaccaccgcgataactttgataatggcaaaccagaactccatctcgccaaacactttaacgttggtcaggttgatggcgttaatcaccacaaagaatacggcggcagaaacccaggtggggatttccggataccagaactgaatgtatttacccacggcagtcagctcagccatggcaactaaaacgtacagtacccagtagttccagccagaggcgaaaccggcaaaactgccccagtatttataagcaaagtggctaaaggagcctgcgacaggttcttcgaccaccatttcacccagctgacgcatgatcagaaaggcgataaaaccagcaatggcgtaacccaggataatccctggccctgcggactgtattacggaggcgctacccaggaataacccggtccctatcgcgccacccagcgcgataagctgaatatggcggtttttaaggccgcgctttagctgctcgccgtgctgttgaccttccatcatgaaacctcgtgcggtggttgtttttttgatctacgcagtgatgcgtgtgtaagtttgcaattccgtttgttgtattaatttgtttacatcaaagaagtttgaattgttacaaaaagacttccgtcagatcaagaataatggtatgcggcagcgaatgcacccgctttatgcatggttgaagatgagttgcttaaaaagaaaccgtttgtaaagctcagcctcaacccctctcaatatgtagaatgaatttaaattcgttttaattgaattaaaaatcacaaaattggtaagtgaatcggttcaattcggatttttatagtttaataatcgttaaaaaactcctttcctacgtaaagtctacatttgtgcatagttacaactttgaaacgttatatatgtcaagttgttaaaatgtgcacagtttcatgatttcaatcaaaacctgtatggacataaggtgaatactttgttactttagcgtcacagacatgaaattggtaagaccaattgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctccttgcgtgaggcgattcaacgtctcgaagcgaagggcttgttgcttcgtcgccagggtggcggcacttttgtccagagcagcctatggcaaagcttcagcgatccgctggtggagctgctctccgaccatcctgagtcacagtatgacttgctcgaaacacgacacgccctggaaggtatcgccgcttattacgccgcgctgcgtagtaccgatgaagacaaggaacgcatccgtgaactccaccacgccatagagctggcgcagcagtctggcgatctggacgcggaatcaaacgccgtactccagtatcagattgccgtcaccgaagcggcccacaatgtggttctgcttcatctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagtcgtgaagagagccgccgtgagcgttctctgcgtcgtctggagcaacgaaagaattagtgatttttctggtaaaaattatccagaagatgttgtaaatcaagcgcatataaaagcgcggcaactaaacgtagaacctgtcttattgagctttccggcgagagttcaatgggacaggttccagaaaactcaacgttattagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccatatggcgtccttccagtcttccgcaaccatttatgatgtgtgctttaaccacttcttccgtgcacgcaacgagcaggatggcggcgacctggtttacttccagggccacatctccccgggcgtgtacgctcgtgctttcctggaaggtcgtctgactcaggagcagctggataacttccgtcaggaagttcacggcaatggcctctcttcctatccgcacccgaaactgatgccggaattctggcagttcccgaccgtatctatgggtctgggtccgattggtgctatttaccaggctaaattcctgaaatatctggaacaccgtggcctgaaagatacctctaaacaaaccgtttacgcgttcctcggtgacggtgaaatggacgaaccggaatccaaaggtgcgatcaccatcgctacccgtgaaaaactggataacctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggatgaactgctgcgtaaggataccagcggtaaactgatccagctgatgaacgaaaccgttgacggcgactaccagaccttcaaatcgaaagatggtgcgtacgttcgtgaacacttcttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacagtaatccttgctcataccattaaaggttacggcatgggcgacgcggctgaaggtaaaaacatcgcgcaccaggttaagaaaatgaacatggacggtgtgcgtcatatccgcgaccgtttcaatgtgccggtgtctgatgcagatatcgaaaaactgccgtacatcaccttcccggaaggttctgaagagcatacctatctgcacgctcagcgtcagaaactgcacggttatctgccaagccgtcagccgaacttcaccgagaagcttgagctgccgagcctgcaagacttcggcgcgctgttggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggcttccagcgtattggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgacccggcttacgcttacgaagttgctgtcatcatgcatgacggtctggagcgtatgtacggtgaaaaacaagagaacgtttactactacatcactacgctgaacgaaaactaccacatgccggcaatgccggaaggtgctgaggaaggtatccgtaaaggtatctacaaactcgaaactattgaaggtagcaaaggtaaagttcagctgctcggctccggttctatcctgcgtcacgtccgtgaagcagctgagatcctggcgaaagattacggcgtaggttctgacgtttatagcgtgacctccttcaccgagctggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccacttcgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttgtttaaaaattgttaacaattttgtaaaataccgacggatagaacgacccggtggtggttagggtattacttcacataccctatggatttctgggtgcagcaaggtagcaagcgccagaatccccaggagcttacataagtaagtgactggggtgagggcgtgaagctaacgccgctgcggcctgaaagacgacgggtatgaccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccgaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaatttttcgtttgccggaacatccggcaattaaaaaagcggctaaccacgccgctttttttacgtctgcaatttacctttccagtcttcttgctccacgttcagagagacgttcgcatactgctgaccgttgctcgttattcagcctgacagtatggttactgtcgtttagacgttgtgggcggctctcctgaactttctcccgaaaaacctgacgttgttcaggtgatgccgattgaacacgctggcgggcgttatcacgttgctgttgattcagtgggcgctgctgtactttttccttaaacacctggcgctgctctggtgatgcggactgaatacgctcacgcgctgcgtctcttcgctgctggttctgcgggttagtctgcattttctcgcgaaccgcctggcgctgctcaggcgaggcggactgaatgcgctcacgcgctgcctctcttcgctgctggatcttcgggttagtctgcattctctcgcgaactgcctggcgctgctcaggcgaggcggactgataacgctgacgagcggcgtccttttgttgctgggtcagtggttggcgacggctgaagtcgtggaagtcgtcatagctcccatagtgttcagcttcattaaaccgctgtgccgctgcctgacgttgggtatctcgtgtaatgactggtgcggcgtgtgttcgttgctgaaactgatttgctgccgcctgacgctggctgtcgcgcgttggggcaggtaattgcgtggcgctcattccgccgttgacatcggtttgatgaaaccgctttgccatatcctgatcatgatagggcacaccattacggtagtttggattgtgccgccatgccatattcttatcagtaagatgctcaccggtgatacggttgaaattgttgacgtcgatattgatgttgtcgccgttgtgttgccagccattaccgtcacgatgaccgccatcgtggtgatgataatcatcattgtcatgatgatgatggtcatgatcgtcgtcgtcccagtcgatgctgctgaatagtgcgtacgtggtagcaacgcccatgctatagccgaatccgcgtacaaagctgtcaacaaacggttctccggctggtggtggcagataaaccggcggatacgcagtattggcccagttcccgtaaaccacggttgggttgtagttgggaatatagaccacatcaggattggcgggctcaatggaaatgacggttgttgccggctctgtaatgacggggttggcagttaaaactgtattggatggtatgacgggtgccgtgactgtctgttttaccggtacagctttcttcgttgtggtaataactttctgttcggttgatgacttcagcgagccggtttgttgcgccagttgccgcaatcgctgtaccgagtccatcacgtcctgcggctgggccagaaaagcatcgcccaggttttgcacccattgcgggttttcgcccatcaatgccatcaattgtggaaaggccaccagtgatttaacgctggcgtcccacggctggtcagataccgcctgaatagcagcatcgccttgtttaagtggattatcgtgcgaccattgcactgcttgagcaacgtttgtcggataggttgatgccatcagcacctgcgaaagtagggcgtcgggatacagcgcgacgggcgcgacccattgatctatttgtgcagtgctgaatgcggatttgacgacggcgggtgttacgggaggtgcggaaaccgttgcaggaaacgtaaccgcggcagcgtcagacacagccagttgtgtcgattgcggttccacaggcgcttccactgtgcggctttttatatatagcccggtagaggcggcacaaagcccggcactgcaaattagcgccagcacatggggtttaaacggcaaagtcattttcataattcggatctcaaggaaatcgcaatggtcggcgaactgccacccgcaggtgctgtgaatccgagtataaagaggcggtagtttaaattttgactaatcttgggattcgttgagaaaggtgattatcaccatgcgaattaacgaagtttttacggagggaaacaatctctagaccatccttaacgattcagccacttttttatgttgcttttttgtaaacagattaacacctcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttcccccaggcgtcgatgaagccgcctatgtcaaagcaggcttcctggctgctatcgcgaaaggcgaagccaaatcccctctgctgactccggaaaaagccatcgaactgctgggcaccatgcagggtggttacaacattcatccgctgatcgacgcgctggatgatgccaaactggcacctattgctgccaaagcactttctcacacgctgctgatgttcgataacttctatgacgtagaagagaaagcgaaagcaggcaacgaatatgcgaagcaggttatgcagtcctgggcggatgccgaatggttcctgaatcgcccggcgctggctgaaaaactgaccgttactgtcttcaaagtcactggcgaaactaacaccgatgacctttctccggcaccggatgcgtggtcacgcccggatatcccactgcacgcgctggcgatgctgaaaaacgcccgtgaaggtattgagccagaccagcctggtgttgttggtccgatcaagcaaatcgaagctctgcaacagaaaggtttcccgctggcgtacgtcggtgacgttgtgggtacgggttcttcgcgtaaatccgccactaactccgttctgtggtttatgggcgatgatattccacatgtgccgaacaaacgcggcggtggtttgtgcctcggcggtaaaattgcacccatcttctttaacacgatggaagacgcgggtgcactgccaatcgaagtcgacgtctctaacctgaacatgggcgacgtgattgacgtttacccgtacaaaggtgaagtgcgtaaccacgaaaccggcgaactgctggcgaccttcgaactgaaaaccgacgtgctgattgatgaagtgcgtgctggtggccgtattccgctgattatcgggcgtggcctgaccaccaaagcgcgtgaagcacttggtctgccgcacagtgatgtgttccgtcaggcgaaagatgtcgctgagagcgatcgcggcttctcgctggcgcaaaaaatggtaggccgtgcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtcattcactcctggctgaaccgtatgctgctgccggataccgtcggtaccggtggtgactcccatacccgtttcccgatcggtatctctttcccggcgggttctggtctggtggcgtttgctgccgcaactggcgtaatgccgcttgatatgccggaatccgttctggtgcgcttcaaaggcaaaatgcagccgggcatcaccctgcgcgatctggtacacgctattccgctgtatgcgatcaaacaaggtctgctgaccgttgagaagaaaggcaagaaaaacatcttctctggccgcatcctggaaattgaaggtctgccggatctgaaagttgagcaggcctttgagctaaccgatgcgtccgccgagcgttctgccgctggttgtaccatcaagctgaacaaagaaccgatcatcgaatacctgaactctaacatcgtcctgctgaagtggatgatcgcggaaggttacggcgatcgtcgtaccctggaacgtcgtattcagggcatggaaaaatggctggcgaatcctgagctgctggaagccgatgcagatgcggaatacgcggcagtgatcgacatcgatctggcggatattaaagagccaatcctgtgtgctccgaacgacccggatgacgcgcgtccgctgtctgcggtacagggtgagaagatcgacgaagtgtttatcggttcctgcatgaccaacatcggtcacttccgtgctgcgggtaaactgctggatgcgcataaaggtcagttgccgacccgcctgtgggtggcaccgccaacccgtatggacgccgcacagttgaccgaagaaggctactacagcgtcttcggtaagagtggtgcgcgtatcgagatccctggctgttccctgtgtatgggtaaccaggcgcgtgtggcggacggtgcaacggtggtttccacctctacccgtaacttcccgaaccgtctgggtactggcgcgaatgtcttcctggcttctgcggaactggcggctgttgcggcgctgattggcaaactgccgacgccggaagagtaccagacctacgtggcgcaggtagataaaacagccgttgatacttaccgttatctgaacttcaaccagctttctcagtacaccgagaaagccgatggggtgattttccagactgcggtttaaaaagtcagcgcacgcgctgcgcataaacgacacaatgcccggtgaatgagattcccgggcatttttttatttctaaaccatcgccgttccgctgtttttctccggtaaggctgcgataattacatcaatggcgcaatgcgatttcggtgcattgccgggagcagaggaacacactatggattacgaatttctgcgcgatattaccggagtggtaaaggtgcgtatgtccatggggcatgaagtggtcgggcactggtttaatgaagaggtgaaagaaaacctggccttgcttgatgaagtggaacaagcagcgcacgcactgaaaggtagcgaacggtcctggcaacgggcagggcatgaatacaccctgtggatggacggtgaagaggtgatggttcgcgccaatcaactggaattcgctggcgatgaaatggaagaggggatgaactactacgacgaagaaagcctgtcgctatgcggcgttgaggattttctgcaggtcgtggcggcttaccgcaatttcgtgcagcagaagtaaataaatctggcggagcctgggagctccgccagagccgttaaacagctggcatattgcgcccgtaataaatctcgcgcatttctttccacagcgcagcggtaatttcctggcgctcgctgtcggttaagtcttccggtttggtgtggaacatgtagtgcttaaggtcgaactctttaagcaacatcttggtatggaagatattttcctgatagacgttcacatccaccatgtcatacagcgccttcatatcgtcagacataaagttctgaatcgaattaatctcatggtcgataaagtgcttcataccgttaatgtcgcgggtaaaaccgcgcacgcgataatcaatggttacgatatcggactcaagctggtggatcaggtaattcagcgccttcagcggagaaatcacgccgcaggtagagacttcaatatcggcgcggaaggtacataaaccgccttcaggatgactttccgggtaggtatgtacgcaaatatgacttttatcaagatgggcaacgaccgtttctggcagtgggccggggtgttctgttttgtcgatgagtttcgggtcaaccggttcttcactcaccagaatagtgacgctggcaccctgtggttcgtaatcctggcgggcgatgttaagaatattagccccgataatggaacaggtttctgacaggatttcggtcagacggttggcattatagagttcatcgatataagcaatataaccgtcgcgctcttcggcagttttggcgtagcagatatcgtaaatacaaaaactcagacttttggtcagattattaaagccatgcagtttcagttttttcaatttcttatcttctccttaggacggctgtgaagccagtgcgtcttgcagatactgaggtaaggcaaaagctgccgtatggattgccggattgtaataacggcatttcaggccagaggcgagaaaacgcgcctgaataatttcggttgagagatggcgtaaggcgtcgttatctgtcgcccatgcaaaagtcatgataccgccgtaataggtcgggatcgccgcctgataaaagccaacgtcgctgaagtaatggctgagtttgcgatggctgtcgatggcttcttcctgctgtaaaaagcagacgccgttttgtgcgacgaagataccgccaggattcaggcaacgtttgcagccttcataaaatgccgaagtgaaaaggctttcgccgggaccgataggatcggtgcagtcggagataatgacatcaaaggtctggctggtttgattaacgaaattgacgccatcgtcgatcaccagcttaaagcgcggatcgtcgtagctaccggcgttatggttgggtagatactgacggcagaacgatacgacacccgcatcgatttccaccatcgtgattgactcaacgtttttatgtcgggttacttcacgcagcatggcaccgtcgccgccgccgataatcagcacatgtttcgcgtgaccatgggccagtagcggaacatgggtcatcatctcatgatagataaactcgtcgcgctcggtggtttgtactacgccatccagcgccattacgcgaccaaatgcagcgttctcaaaaatgatcagatcctggtgatcggtcttttcatgatacagaacgttatctaccgcaaagtactgcccaaactggtcgtgtagcgtttcatgccactgttttttttcggccatgggttgatacctcctttgttaacacccgtaaaaaaagggcgcaacataatagctaacattgaccgcggatgcacggtcaatatttctacaaaaaggtatcagggattatttgacgtaggcaagcaggcttaaggaatcgcgggccagggctttgcattttttagcgacgggaatgccaatgccgctgagatcgcggtagctgtcttcaccgagggctttcatgtcgaaggtgtcgtaattactgaggtcccactggttttgctgagcgaaaaagaccagtgcgcgacgaatttgcccgttaggtaagttctggtaaccacaatcgttcttcagaaagacaaaaactgccgttaaatcggccatatcttcggcttcagactcgctgagcgcgtaactgtttgcgcagacggccatcaggctgccgaataacactgttctgaaaaacgtcttcattgcttctaccaggggcttaaagaagataaacgttagcacactgcgagcgaggcgacgaccattattgtcgattaaattgtgtctgcggcttgaccttcccgtaaggggaaggactatgctcaacgtttgattttgtttcgcctgcttaagaataaggaaataactatgcaacgtcgtgatttcttaaaatattccgtcgcgctgggtgtggcttcggctttgccgctgtggagccgcgcagtatttgcggcagaacgcccaacgttaccgatccctgatttgctcacgaccgatgcccgtaatcgcattcagttaactattggcgcaggccagtccacctttggcgggaaaactgcaactacctggggctataacggcaatctgctggggccggcggtgaaattacagcgcggcaaagcggtaacggttgatatctacaaccaactgacggaagagacaacgttgcactggcacgggctggaagtaccgggtgaagtcgacggcggcccgcagggaattattccgccaggtggcaagcgctcggtgacgttgaacgttgatcaacctgccgctacctgctggttccatccgcatcagcacggcaaaaccgggcgacaggtggcgatggggctggctgggctggtggtgattgaagatgacgagatcctgaaattaatgctgccaaaacagtggggtatcgatgatgttccggtgatcgttcaggataagaaatttagcgccgacgggcagattgattatcaactggatgtgatgaccgccgccgtgggctggtttggcgatacgttgctgaccaacggtgcaatctacccgcaacacgctgccccgcgtggttggctgcgcctgcgtttgctcaatggctgtaatgcccgttcgctcaatttcgccaccagcgacaatcgcccgctgtatgtgattgccagcgacggtggtctgctacctgaaccagtgaaggtgagcgaactgccggtgctgatgggcgagcgttttgaagtgctggtggaggttaacgataacaaaccctttgacctggtgacgctgccggtcagccagatggggatggcgattgcgccgtttgataagcctcatccggtaatgcggattcagccgattgctattagtgcctccggtgctttgccagacacattaagtagcctgcctgcgttaccttcgctggaagggctgacggtacgcaagctgcaactctctatggacccgatgctcgatatgatggggatgcagatgctaatggagaaatatggcgatcaggcgatggccgggatggatcacagccagatgatgggccatatggggcacggcaatatgaatcatatgaaccacggcgggaagttcgatttccaccatgccaacaaaatcaacggtcaggcgtttgatatgaacaagccgatgtttgcggcggcgaaagggcaatacgaacgttgggttatctctggcgtgggcgacatgatgctgcatccgttccatatccacggcacgcagttccgtatcttgtcagaaaatggcaaaccgccagcggctcatcgcgcgggctggaaagataccgttaaggtagaaggtaatgtcagcgaagtgctggtgaagtttaatcacgatgcaccgaaagaacatgcttatatggcgcactgccatctgctggagcatgaagatacggggatgatgttagggtttacggtataaaaagaccgtattcggaaatatgcccggatctctccgggcattaaactgatgacaaacgcaaatctgcctgatgcgctacgcttatcaggcctacgctagctgtgcaatccattgattttgcacaattttgtaggctggataaggcgttcacgccgcatccggcatgaacaacgcgcacgttgtcagcaatctgagcaagtcttacttcacatcatccggcagcgcataagccacaatatagtcgcccatcttcgtaccaaatgaaccgtgaccgcctgcggagatcaccacatactgcttaccattcacttcataggtcattggcgtagcctgaccacccgctggtaaacgaccctgccacagtttttcaccgttgctcatgttgtaagcgcgcaggtagttatctgccgtagcggcgataaacagcacgttacccgccgtggagattggcccgcccagcatcggcatacccatattgaacggcaccggaaccggcatcgggaacggcatactgtcctgcggcgtaccaatacgtttcttccacaccacttcattagttttcagatccagcgccgagatataaccccatgctggctgtttacatggcagaccaaatggtgagaggaacgggttgagcgtgacaccatacggtacaccgtactgtggctgaatgccggattccgtacccgtgcctttggcatctttcggctgctccatcgggttgccaggaccacgcgggatcagtttcgaaacaaacggcagtgccattgggttggcaatcgccacttcacgatttggatcaacggaaatcccgccccattcgaacatccccaggttacccgggaagaccagcgtaccctgttcagatggcggggtgaaaatgccttcatagcgcatctggtggaacatcacgcggcacaccagttggtcaaacatggtggctccccacatatccgcaccgctcaaatctttcgtcggacggaagctcagttcagaaaacggttgagttggggttacgtaatcgcctttcgctgcaccttggggaaccggtttttccggtgccggaaccaccagttcgccattacgacgatcgagcacaaaaatgttgccggttttcgccggagcgtaaataactggcactttctgaccattaacggtgatgtccgccagcgtcggctgtgccggaagatccatgtcccacaggtcgtggtgaacggtctggtagctccacgccagtttcccggtagtggcattcagcgccagaatcgagctggcataacgttcctgttccggtgtgcggttaccgccccagatatccggcgtggtcacgcccatcggcagatagaccagatccagcttcgcgtcataggccgctggtgcccaggagtttggcgagttaaaggtaaaggtgtgttcgtcagacgggattgcgttcggatctttcgcgccgggatcaaaagcccacagcagctccccggtgttgacatcaaaaccacggatcacgccagacgtttcgcgggttgagaagttatcggtaactgaaccggccatcacgatggttttatcggtgataatcggtggcgaagtcggttcatacagacccggtttggtgtctggcatattgctttgcagattgagcacgcctttattggcgaaggtttcgcacagtttgccgttttcagcgttaatcgcaatcagtcgaccatcattgaccggaagaatgatacgacgcgggcaatccgccatcacttccggcgaagcggtttctgctttggcttcatgataagagacaccacggcaggttacgtgctggaaagactcgttggttttcagctcaggatcgtaatgccatttctctttgccgctggcggcatcaagcgcaaacaggcgctggtgagcggtacacaggtaaagggtgtcgcccactttaatcggcgtcacttcattggtgatttcacccggatcgttcggctgcttcacatcgccagtacggaacacccaggcttctttcagattatggacgttatcggcgttaatttgtttcagcggcgaaaagcgttgaccttcctgattacgaccataggcaggccagtcctgatcggctacgggggagatagcttcagcaggtgtggcatcggcgcttaaggtgccgttgatctcctgcggatcgttaaatccggcccaggtcaggataccaccgctaatcagcagtgcgaccaccagtgcggcaactgcgccgctggcaggaatgaccaggcgacgccagacaaacggcaggatcagccagatgccgaagaagaccagaatgtcgctgcgcggagtcagcgcccagaagtcgaaaccaacttcccagacgccccaaatcatggtgccgagcagcagggctgcgtatagccaaagcgcggcgcgtttactgcgccacagcatccaggcgacgccgagcatcacaaggccagcgatagggtagtaccaggagccgccaatcgcgaccagccagcctccgccaatgagtagatacagcccgcaaagcgctgcaaaaagggctgttagcgtgacgagtaatcgtcgcgagcctgtattgttaattgccataaagagacaccatttcaattcattaatattttagtagcaattaattataggttttaacatgtgtgatcgtcatcacaattcgagctttattaacagattccgcgaatgaatagttttactggtatactgcgtgtcttgcgctttgttgcggtgccaaaacctgcccgtgcgaagtgatttgtttttaaatcatatggttagagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagatctggatgaagatatccgtggcaaggacgtgctgattgttgaagatatcatcgactcggggaatacactgtcgaaagtgcgtgagatcttaagcctgcgcgaaccgaagtcgctggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaagtgtgaagttgccggatgtgttgcatccggcatggcatttttatttgtggttggcgtgtttcagcttgaggttggaaatcccgtgacggtaacgttgctcaagggtttcgcggttggtggcggtaacatccagatcacgcagcaagccgtcgtgaatgccgtaggcccagccgtgaatggtaactttctgcccgcgtttccacgctgattgcataatggtggagtggcccaggttatacacctgttccatgacgttcagttcacacaaggtatccagacggcgctcttgcggcatttcgccgagcaatgagctatgtttgaaccagatatcgcggatatgcagcagccagttgttgataagccccagttccgggttttcaactgcggcttgtacgccgccgcaaccgtagtggccacagataataatgtgttcaacttcgagtacatccactgcatactgaaccacggaaaggcagttcaggtcagtgtgaatgaccaggttagcaacattacggtgaacaaagagttcgcccggctcaagaccggttaaacgttctgcaggaacgcgactgtcggaacatccaatccatagaaagcgcggtttttgcgcttgtgccagtttctcaaaaaacccgggatcctcttccaccagcatttttgaccatagtgcattgttgctgatgagtgtatctatgtctttcatggaggttaacgacctgtaaccaaataattacgtttggctaatatagggcaactccgggacgatttaaaccacagataaagtgtaagaacgtaaggtaagtaaaaatttatgaccattgcactggaacttcaacagcttaaaaaaacctatccaggcggcgttcaggcgcttcgtgggatagatttgcaggtcgaagcgggtgatttttatgcgcttctcgggccgaacggggccgggaaatcgaccactatcggtattatcagctctctggtaaataaaacctccgggcgggtcagcgtatttggttacgatctcgagaaggatgtcgtgaacgctaaacgtcagttgggactggtgccgcaggaatttaacttcaacccgtttgaaaccgtgcagcaaattgtggtgaatcaggcagggtactacggcgtggagcgcaaagaagcgtacatccgcagcgaaaagtatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacactacctggaagaagcagaaatgctgtgccgcaatatcggcattattcaacacggtgagctggtggaaaatacctcgatgaaggcgctgctggcgaagctgaaatcggaaacctttattctcgatctcgcaccgaaaagcccgttaccgaagctcgatggctatcagtatcgactggtcgataccgcgacgctggaagttgaagtgctgcgtgagcaggggatcaacagcgtatttacgcagttaagtgagcagggcattcaggtattaagtatgcgtaacaaagctaaccgtctggaagagctgtttgtttcactggttaatgaaaaacaaggagatcgcgcatgatgcatctttactgggtggcgctaaaaagcatctgggcgaaagagatccatcgctttatgcgtatctgggtgcagacgctggtgccgccagtcatcaccatgaccctttactttattatcttcggtaacctgattggttcgcgtattggcgatatgcatggcttcagctatatgcagttcatcgtaccggggctgatcatgatgtcggtgatcaccaatgcctacgccaacgttgcgtcatcattttttggtgccaagttccagcgtaatattgaagagctgctggtagcgccggttccgactcacgtcattattgccggatatgtcggcggtggcgtggcgcgtggtctgtttgttggcattctggtgacggcaatttcactgttttttgtgccatttcaggtgcattcgtgggtattcgttgccttaacgctggtgctcacggcggtgttgttctcccttgcgggtttgctgaacggtgtgtttgccaaaacgttcgatgacatcagcctggtgccaacctttgtgttaacgccactcacgtatttgggcggggtcttttactcactgactttgttgccgccgttctggcaagggctgtcgcacctgaacccaatcgtttatatgatcagtggtttccgctacggcttcctcggtatcaatgatgttccgctggtcactacctttggcgtactggtggtctttattgtggcgttttatttgatctgttggtcgctgatccaacgtggacgtggtttgcgtagctaaggctatttcctctcctctggatttgggggagaggagttttgacggctatcaccctttatcaacaatggtcagggtagactgattttcggctaaggaggaaggcgatgttaggttgggtaattacctgtcacgatgaccgggcgcaagagatactggatgcgctggagaaaaaacatggggcacttcttcagtgccgggccgtgaatttctggcgcggattaagctctaatatgctcagccgcatgatgtgcgatgctctgcatgaagcggactctggtgagggtgtcatcttcttaaccgatatagccggagcgccaccgtatcgcgtggcttcattattaagccacaaacactcccgttgcgaagtgatttctggtgtcacgttaccgttaattgaacagatgatggcttgccgtgaaaccatgaccagttcagagtttcgcgagcgtattgtcgaactgggtgcgccggaggtgagtagtctttggcaccaacaacaaaaaaatccgcctttcgtcctcaaacataatttgtatgagtattaacccgcgattctgatggcgcttttgctacaataaaagcgttgtttcaccctcggttattttttcatgtacaaacaagctgttattctcctgctgatgctgtttaccgcaagtgtcagtgccgcgttacctgcccgttatatgcaaaccatcgaaaatgctgcggtctgggcgcaaattggtgacaagatggtgaccgtggggaatattcgggccggacaaatcattgccgtggagcccactgccgcaagttattacgcatttaattttggctttggcaaaggttttatcgataaaggtcatctcgagccggttcaggggcgacaaaaagttgaagacggtttgggcgacctcaacaagccgctgagtaatcagaacttagttacctggaaagatacgccggtctataacgcgccgagtgcgggaagtgcgccatttggggtactggcggacaatttgcgctacccgattttgcataaactgaaagacaggttaaatcaaacctggtatcagatccgtattggcgatcgactggcctatatcagcgcactggatgcccaacccgataatggcctgtcggtgctaacctatcaccatattctgcgcgacgaagaaaacacccgttttcgccatacttcgacgaccacatcggtacgcgctttcaataaccagatggcctggctgcgtgacaggggatacgcgacactgagcatggtgcagctggaaggctacgtgaagaataagatcaatctccctgcgcgagcggtggtgattacctttgatgatggcctcaagtcggtgagccgctatgcgtatcctgtgttgaaacaatatggcatgaaggcgacggcgtttattgttacctcacgcatcaaacgtcacccgcagaagtggaacccaaaatcgctgcaatttatgagcgtttctgagcttaacgaaattcgcgatgtatttgatttccagtcacatacccattttttgcatcgggtagatggttatcgccgacccatattactgagccgtagtgagcacaatattctgtttgattttgcacgttcacgccgcgctctggcgcaatttaatccgcatgtctggtatctttcgtatccgtttggcggatttaatgacaacgccgtgaaggcagcaaacgatgccggatttcacctggcggtgacaaccatgaaaggcaaagtaaaaccgggggataatccgttgttactaaaacgactttatatcttaagaacggattcgctggagacgatgtcgcggctggtgagtaaccagccgcagggataacaatcaagcaacctgtaccggaatcgctttcgcggtacgtttcatttcattgtcgccttcaaaataggcgacgttgggtcgccaggtgcgagcttcttcatctggcatggtaacgaagctggcgatgatgacaatatcgccgacactggcgcagtgggccgccgcaccgttaacagaaataattctcgaaccgcgttctgccgcgatggcataagtggagaaacgcttgccgttggtgacattccagatatcaatggcttcgttttcgagaataccggctgcgtcaagaaaatcctggtcaatggcgcaagaaccttcatagtgcaggtccgcatgagtcactttcacgcggtggagtttgccctgcagcatcgtgcgaatcataacttctacctttctaccctgtcgttaacgaagcaggcgatgcctgctttgaggaaattctcacgcagtattgcccgatttttgtttagtgtctactcatctgacggcatttgcgtcagcagtttgcgtaccgcgccgaagcgtgccatgtatcgcctgtaacgaattgatatttctctgaacgctgctcggtaaacaataaagaggtggctgacgatagcgcgccttgactggatactgccttcacgcaaagccacacggaagacagggaagatggatgcaccgagtaccacaccgcatgacgcggtatttaaacaatttttaatgcatgcggagacggctcgcgactttctggagatacatttgccagtggaattacgcgaactttgtgacctcaacacgcttcatttagagtcggggagtttcattgaagagagcctgaaaggacacagcacggacgtgctctattccgtgcaaatgcagggcaatcccggttatctgcatgttgtgattgaacaccaaagcaagccggataagaaaatggcctttcgcatgatgcgttattctatagccgccatgcaccggcatctggaggctgaccacgataagctgccgctggtggtgccgatactgttttatcagggcgaggccacaccttatccgctatcaatgtgctggtttgatatgttttactcgccggagctggcgcgacgcgtctataacagtcctttcccgctggtggatatcaccatcacaccggatgacgaaatcatgcaacatcggcggattgcgattctcgaactactgcaaaaacatattcgccagcgcgacttaatgttattgcttgagcaactggtcacgctgatcgacgaagggtacactagcggaagtcagttagttgccatgcaaaactatatgctgcaacgcggtcatactgaacaagcggatttgttttacggtgtgttgagagacagggaaacgggaggggagtctatgatgacgctggcgcagtggtttgaagagaaagggattgagaaggggattcagcagggaagacaggaagtaagtcaggaattcgcccagcgtcttctgagtaaaggaatgtctcgggaagacgttgcagagatggcaaatttacctcttgctgagattgataaggtaattaaccttatttaagttacctgtgttatgacagatgacgtggggtaaattaataactggcgccatcagccgtagcgccagttaagtattacgccagctcgaccattttgttgtcgatcaggcgagcatcgccaagccaggcggctaccagaattactgcccgtttgctggtttcagaaacttccagcaatgtgtcggcatcgcgaatctgaatatcatcggcgcggaagcctttttcattcagttcttgccccgcaatggtaataatttcatcgagatcccgttccccagcctgcaatttgtcagcaatcgaacttaaaactttgtacagaccaggcgcaattttgcgttgttccgccgtcagataaccgttacgggaacttagcgccagaccgtctttggcgcgcataattggcacaccgacaatctcaatatcgaagcccatatcggcaaccattttgcggatcagcgccagttgctgaaaatctttttcaccgaagcaggcgatgtccggctggaccaggttgaacagcttgctgacaatagtcgaaacgccgcgaaaatgtcccggacggctggcaccttccagcatggtcgaaaggccaggaacgtcaacgtaagtgtgggtttcagtaccgttcgggtagatctcttttaccgaaggggcgaaaactaaatccactttacgtttgtttagcttctcgcagtcctcctgcaaggtccgtggataacgagccagatcttccgggcggtcgaactgcatcgggttaacgaaaatactgacgacgaccacatcggcgcgggctttggcttcgtcgaccagcttcatatggccatcgtgcaggttacccatggtaggcaccagcgccacgcgcttgccttccatacgcaggcggcgaatttgctgacgcagcagcggcagggtttcgataattaacacaacgtgactccttaatggaaactgtgttcttcgcccggataaacgccggactccacttcagccatatactgccgcacagccgcgcggatgtcgcccgtttcggcgaggaaatttttagcgaatttaggaatgtgaccgccggtaataccaaaggcgtcgtgcatcacgaggatctgcccgtcagtgacgttgcctgcgccaatgccaataaccgggatcgccagtgcttcggtaatacgttttgccagttcaaccggcacgcattccagcaccagcagctgtgccccagcagcttctaaggctaatgcatcgctgagcagttgatcgcccgcttcatcgccgcgcccctgaactttgtagccaccgaaaatattcactgactgtggtgttaaacctaagtgaccacatacaggaacggcacgttcggtcagcatttgtacggtttctaccagccactcaccgccttcaattttgaccatgttagcaccggcacgcataaccgttgcggcgttttcgaaggcttgttccggcgtggcatacgccataaacggcaggtcagccagcagcaggcagtttggtgcgccgcgacgtacggcggcagtgtggtaggcgatatcggcaacggtaactggcagggtggagtcgtgcccctgaaccgtcatgcccagcgaatcgcccaccagcatgacgttaagcccttcatcagcaaagagtttggcgaagctatagtcataagcggtgatggtcgcgaaacgttttttttcctgtttgtacttctgcagtaaggagatggtggtcggtttcataacgtatcctgataaattgatgttgtgctgtctggcattttatcagtcacattggtgggggcaatgatttatccgtagcagcactgccagaaggtgacagtgctgctacgttatcagggataggttacctggaaagtactggtggctttaaattcgccgggttcgatagcaatattcccgtcttgctttaatgttgcctggaaatgaagaggctgtgatgtgccgttaccttgattagggtaaaccccatcggaggtgtcatcttcggtttcataatctatataaacagaattcgtatcattaggttttaatgtcattagcggatttttactggttgctaaaccttcaatgagtacgccaacgcctttggcggcagtgcttccagtaagcgtattaccaagcagttgtgtgttttgagtacctacttttccagtgacgagttttgtttcaatattacgcacacgaatacaattctgaagcgagatatcaaagggaacaggtgaagcgccatttttaattgtcccagagctatattctcccattctaaccgttgaaccattgactgatggcccggtaagtatggaggtaaaacatgttggtaaggttaatttgacattattcagtgtgaaattgacataaatgtggttgctgtgatctacaacttttgtaccaggactgtaggccttaaacgaataaaggtaatttgatgaactggataactggacttgctgattaagtgtaggatcgaaattagtatctgtataaaattcaacagttatgttgtgtactataccaccaatagcccaaaacttatcgtagtcgtctgctttgttgcaacccttagtttgtagatcgctgtctgtgacggaaaagaaaaattcttggttggaaggatctccgatatagattcctggcgattgaatgtcagttattgtatcgtatgcagaccagacccttgatattaacatggtgtaatacagaccaggaacagatgtattaaatagtttatgtccgccataatctttacctgaatagaccatggcattttcaatagttattggaccaggattcgctctgccagatgtattgcagtaaagaataccaccaccggtacctgtatccaggtatgaccagtacatttttaccccagtcgggccgagctgcgtgggtttataaaaaaccaagttgcttgctgttgatgtgtaattaaaggtcatctgtgcggcagtggaggggcctcgatagttatcaactcctgcattatttcccacaataaaacttgtatatgcactgactgtattacaacaagaatacagtgctaaaaaaagaatgtacctgaagatagtcttcatttttactccaatgtttctttattgttatggtttgcgctgtttttgtttgttattcgtagtaaatatccactaacacatggctcataagttgaccagatgtaacactcaatgcaggatcgattttttgcattcgggtgctaaatttccaggatgaaccattcatgtcatccgacattactggataaacggaacgagatccgcctgaagcattaagaacattgaatgtattcgccgaatcctgagtagaaaatataactactcctacattacttgctcctgacgaaatttcattagcaaatatttgcctagagccagcagccatgacaccgctaagggctctaaaatcaatatgtaactgatttagcacatcgccagttccctgtaatgcacagtcggatacagtgatagtgaactcttttccacctggttgataactttcaggagtaacattacctgaaaaatatcccaccccaacgacgccaagatcaatattaccctggttactgattccgcttttgcaggtgctgttttttacattggcaacaaggtcaatatcctgtccagcaatggctggacaggcgatgcaaaacagtaatgacagaaacagaattattctcttcatcagcttacgttgagtgggatgcatatatagttcctgaatctgtaagtctgttagttataggttactgtaaatgtggctggtgcagaaaacttacccgcagtgacattgtttacggttttatttttttccacgaccaggcgtgcactcatcggataataaacgaccgcattggctgcagtggagattgttacctcttgtgatgctggtgttacacagctaaattgtgttgcactccctgttgccggagttacagtgctccagacttcaacggcgacagcacttgctttatctgcggctgtggaaccatttgcaaaccccgcaccgtcattagcagttccctcgcatgtggctcgcttggttaattttatttgcgcttttttattggggatacccgcacagtctttgaatttgagtttgaatgtttttactttggtcttggcattgatttcagaaatatatacatcaccaaaatcaacaacagaaatgtcctgatcagagtcatttactaatgtagcggtacaagtacccatttctacagtagtaataacggtcagtccaatactgtctgttgccgcataagagagtacgctgaacaatgaggcagccaaaacgacactgctggataatccataacgtaaatttttaaatgtcatcataattatccttcttattgatagatgaaattaaacgtcgccagtgcacgaaaattccccggtacgccttgccctgcatctgtttcacgtagcgcaacggtcatttcaagacccttatcgggctgcatctcgtctgtgctccagcgtatcttttccgcactgttaggtttaaggaaagtggcatcatcagtagtccgttttttgaaacccataccgatattacttgtcgtcgaagatgaatcaccagactgcggtataataagcttaggtgagcttgatgatgcatttccggtcagagtggtatcaatccaactgatgccactgctgcacccactggcaaccagtttaaaatcagcctgagattctgtcgttttattcgcgatcttatccagacccatcttagggattctcaatgtgtagttattattgccatcattcgtgacgttattaccagtaagtgtgatgttacaggttgtcgctttgacagtggctgtaaactctacattaatatccgttgcaaatactgagggtgataataatattcccatcagtatcactattttatgtggcgttgtttttatcatttgacgtcccttgtagttactgaatctgacaccgaattccattcagaataatagattgtgctattttttctgcttctgggctttgttgataatgcgcaagacaacttacgggtttactttgttcgagccatttaatgctgatatttccctgctgctcaataccacgaacaaatgcttgtccaccctgtccaacattaccaatgacattgccttgctcatcataaatatctgcagcaaatggaatatttttaccatcacttcgtgtgatgttcataatggctgattgcccttgcacggtttcaaaatcagcaaagacgactgaaccctgacgcggtacagctactgcactggtactttttaattcaacatcgttctcaagatcgttgatatccagcgcgatacggttttcatgataaggagaaagagcgctggtgacaccataaccccatcgatcgatagtactgttgccataatttattcgcgctccttgagcacctggagcctgaactaccgccagtgtatcggagtcgctaaaactatcattactgaaagtcagtccaccgctatgcaatacaaaaccaccgtcggtgctgagagaaacttgacggctgttatcgctatttgcagaaattgaacctgccagcgttccccatggtgactcatagctggcataacccccaacataactcaaatctttgctggctttattcatcgtatagccagtattcacgctataactgacgcgagcgttatcgctatagccactgctgctaacgttgagttggttattacccttaaagtcactgcttatttgagtatcaatactctggaaacctgaagtacgttgttcagtgccaagtaatttttcaattggaatggtgaaactaagataaacgctatcgtcagtgtcgccgtcttcattccatgaacgctgggcactgacactgtagctgccccaggatgtactgttactgtagccaatagagtaattgctacgattttgtccggaagcccagtaatcggaccaacttccggaaagataaaatgaaccgtaatcttttttctcaaatttcaacggttggttaatactgaccgtaacctgatttttcatgcgtgagtaattacgcatggatttcggttcaagatcttgttcgggatgtttcacttcatcaattagagttagtgcatcattaagaccaaggtaattctgtgtcgaatagcgataggccgcgatattcagtgaagtacttgtttcttcgaataacttgttccaggaaacacgataactttgcccctggtatgttttatcatccgggatacgaacattggaatgagtcacatcgaaagaaaatgcaccaactgaagtattcagaccaagacctaacaaaccagcggtatagttattatcggttatctgaataccggtataacccgtcagatagttattcaggccgtagtagtagcttgcttgaaataaattaggctcatcctgaatatcatcttttaagacctgaccgccgctaatatcccaacgtccaacgccagggcgtaacatttgaacaacggatgagaaaggttgcgagaatgtccgctttgagccatcggattcttcgatggtaacaataagatcgctgccgtaccctgacggactcagatcatcaatgacgaaagcgcctggcggcaccgtcgtttcataaatcttatagccaccttgcgtaatagtgactttggcgttggtattggcaacgccatgaatgataggcgcaaagctggctaaagtcggaggcaacatgcggctgtcactgtataaacgaatgcctcggatactgacggaatcaaaggtttcgcccgtcgtataagactcaccaagaatgagttgagaacgcagcgaggcgatatcacgctgaacataccgattcttaaaatcataattactgccagaatcggtcatccagttgtagttgcccgaggcacgcagtcgccatgcacctaaattcatcccaccgttaaatgcagcataaatgctttcattttttcgaccaggggtttcactatgatatccgttgaggttgtatgacaacatggccgcattaatgccgttttcccataacgatggatcaacatagttttggtaatttttcattacccaggcttgaggaacgtctatatccagacgttgatcgttaacgtcataacgaacagaagcctgagggataatttccgtcaaattgaggcaattgccgagcgtttcatccctggcaagcagaacggctttttcgttatttatatcgggagaattaatatgaaactgcaataaattctttaatgtgatacaagcctgggcgttcttttttccttcaattgcgacaaatgtaatactttggttaatgattggttggtcgtttacataaacactgacgtcgtaaacacccggtatagcggggttaccttcactgtaccggctgagatcaatattagatgcattctgccccatcaggaaggtatggtcatattcaacgagttcagcactgaaagcagtattgcaatacagcagcgcgcaaaacgtggcgatacgggtcagatgatgataatttttagtatattctatagtcacgctatgcttcctgcggaattatatccttgcctgattacagcctggcattaccttcaattgcgccaccaaagtcattaatggcgtaaaaatgcacttttgcagaattcgctttgccattaaggccattgactttcatgacctcatcactaaatggtgcaatcattttcacatcaatcggatagcgtttaccgctagcttctaaatcaccactgctaaaagagacgtagtaaggggttggattggtcactcgtaatgacgccttaccttctgaacctgaccagaaccacttcagggctaacggggcttcagagggatttcccttcaatccatccgggcgatagaaaagttttatacgtgtgcgaaatgccagttgcagcaggctttgattcgcgaccttttctgcatctggttttggtggaacttccagtacgttaaaccagaacacgctctctctgtctttaggcagtgaggtgctggctgtgtacattaatttgattgtttgcccacgtttggcatcaatacgcgatactggcggcgtagcagtaaaagggactgtaatactgccaggctcagcgttgtcatcgccagtatctaaccaactctggacaagcaacgggttattccctttattttccagacgtacgttgacacttttttgatcgcttttatatattacgcgagtacccgaaatgacaatgtccgcaatagacgatgaactaaaagccatacaggttacgaagcataaagctgttgtatgtttggtgttaaaaaacataaaccatccctgatagagttaattaaaacagggaataatataaaatagaaattattattccctgtatattcattcaatcaatttaactggtgaatacttactgataagtaatggtgtatgcagtgttagtttttacataaccagcagttgctgtttggtctgcgacggcacgaacgtaagacgctttaaaatcataaacagcagattttgtcgttgcatccagggctttagtatacacatcgccagggttgttaatttgaacctgtttgatagtggaaccatcaatattgtgtagagcgatattaacgccgtcagatgggttgttaatagacatgtcgttgttcaaagtccctttgctgttaccaaagaaaacagaaccgaaggtcattttagccgtgctacctggattcggatttgctttgctgcagtcaacggtgatgctgaaaggtttagctttagcgccaacggtgtcattcagtacgccagcatcgatttcaccaacggttgcggtttgcagcaggatcagaccatccttgttaccgccgtcaacgcgggtttcacaggtgttatcaacaaccagaccactgatatttaactgaccgccgtccatatcagcagaagcagtacctgcaaccatcgccagcataagaccagacagggcaaaacctaattttttagacataaaaatcctttaataaaattccattagtcagactacatgtttgaagaatgactattcatgacacaaataggagaaacaaatgttagatattaatgagcaatgatatttgttacccaaatttacaaccattgttcattaggtcgcctattgtgcactttagaagcttttgaacaaattaaatttacttaattcaaaattaagtaaaaataagttcacaagtgcaattggttagggtatggagatgggattgatatttatttataggaagttatattatttccgcaaagagatgtttaaactaaaatcgtaattaaggaaagagatgagatatgattttcagaaaatatttatattcgcaatataaataaattaccatttgtttaatttgtcaaatgctcttgtatgtaagatttgacgcaacatctccccatcaggaaacaccaactccggcgcgatttcaaacagcggccacagcataaatccacgattcttcatatcgtagtgcggaacggtcaggcgttcagtatttatcacttcattaccaaacagcatgatgtcgagatccagcgtgcgtggtccccagcgttcagctttgcggacgcgaccttgctgcaattcaatacgctgtgtgtgattgagtagctcttcaggtgcaagagaggtttccagcgccacggctgcgtttaagtaatcgggttgatcttgcggccccagcggtggggtgcggtaaaacgaagaaacggtaagaatgtggctttcagggatatcgcctaatgctttcagggcagcattgacctgctccagcggagaggccagattgctgcctatggcaatatacgccactgtcatgcggtaccctcacgacgtggtgcgcgtttgcgtggacgacgagtacgacgacgcggtgacggttcttcatccagctcgttgagcatccctttttggtctggtggcgcggaaacctggaactcaccccaccatttcaccagacgctgcagttcagcgttacgctcaacttcagctcgcaaggccaacaggtcataagccgcacggaacttaggatgctccagcagtttccatgcgcgtttaccctgacgacgggacatacgcaactgcaactgccagatatcgcgggttaatgtcgtcagacgtttcgggattgccagtgaacggcaggcttcgtccagcacgtcgttcatcgccagcgcgaaagcgtcgtgataggtcaggccgctttcctgggcgatcttctgtgccgtctccagcagtgggtaccagaacatggcggcaaacaggaacgccgggttcacgcgcatatcgttatggatacgcgtatcggtattcttcagcacctgttcaatgatccgctccatcgggctgtcgccattttccgtgaagtagcgggtaatggtcgggaacagcggctggaacagatgatattcacacaacagcttataggtttcgtaaccgtagcccgcttgtagcagtttaagcgattcttcaaacaggcgtgccggtgggatatcgttcagcagggtagcgaggcgagggatcggttctgcggtttccgggctgatgcgcatacccaatttggcggcaaaacgtaccgcgcgcagcatacgtaccggatcttcacggtagcgcgtttccgggttaccaatcagacggataacgccgtccttcagatccttcatgccgccaacgtaatcacggacggtaaaatccgctacgctgtaatacaggctgttgatagtgaaatcgcggcgctgggcgtcttcttcgatggagccgaaaatgttgtcgcgcagcaacatgccgttttgcccgcgttgggaggtcgtgcggtcgctgacgttaccttcgtggtgtccacggaaggtcgcaacttcgataatctccgggccaaacattacatgagccagacggaaacggcgacccaccaggcggcagttacggaacagtttgcgcacctgctcaggcgtggcgttagtggttacgtcaaaatctttcggctttttgccaagtaacaggtcgcgcacgccgccgccaaccagccaggcttcgtatcccgctttattgagcctgtacattaccttcagggcattttcactgatatctttgcgggaaatagcatgctgctcacgcgggatcaccgtcacctgtggacgggcgactgcctgttcagcctcgctttcctcgcggcttagcaccttgcggcaaaaattagcgactcgggtaaaaatagtacacctcggtagtgtcaaacatcattcaggacaaaaaaatagcggctaatcatagctcagcatgacgcatttgagaatgttgaatttacaattgccgactcgggcacggcggtaagccgccagtttttgacggctgactgaaggatttgctcgacgctgaaatcctgccagtgtgcttctgcctgctgccccagaaattgaagtgccgcgattagtaccgggcgtggatcgcctttcggcaacgcaggcgcatgattctgcttggaaagtttagcgccttgtggattaagcgccagcggcagatgaatgtaatctggcactttccagccaaaaagctggtacagcgagatttgccttactgttggttcaatcagatcagccccacgcactatttctgtaacgccctggaaatgatcatcaaccacaacagccaggttgtaggcgaacaacccatcacggcgatgaatgataaaatcttcccgtgccagtttttcgtcggcgtgaataatgccgcgcagctggtcagtaaattgcgtgaccggatgctgctggcggatacgcactgcggcgttgtctggtccatgatgcaacacccggcaatgaccgtcgtaaataccgccaatgctttgaatacgcgcacgcgtacaggtgcagtaataacttagtccttgttcatgtaaccaggcgagtgcttcacgataggcgtcgtgacgttgcgattgccagagaacatcgccgtcccagtgcagaccgtaatgttccagctggcgcaggatagtttctgcggcaccgggaacttcacgaggcgggtcgatatcttctatgcgtaccagccagcgaccttgccgggcgcgagcctgcaaatagctgccgagcgcggcgatcagagagccaaaatgaagctcgccggaaggagagggggcgaagcggccaatatactgtgtgtctgtcatctctttgaacaaaaaataaggcgggagcatttcccgcctgtggtaaacgtgatggaacggctgtaattagccagccatctgtttttcgcgaatttcagccagcgttttgcagtcgatgcacagatcggctgtcgggcgcgcttccagacggcgaataccaatttcaacaccgcaggattcgcagtagccgaaatcttcgtcttccacttttttcagcgtcttctcgatctttttgatcagcttacgctcgcgatcgcggttacgcagttcgaggctgaactcttcttcctgggctgcacggtctaccgggtccgggaagttggctgcttcatcctgcatatgtgtaacggtgcgatcgacttcatccctgagttgattacgccatgcttccagaatacgacggaagtgcgccagctgggcttcattcatatactcttcgcccggcttctcctgatatggttccaccccagcgatggcgagaatactcagggacgatgttttacggttttgcccttcttgcatgttgcttctccttaacacgcactatcgatccccatgttcgggggaaaaatgaggccgctataaatagcagatgcttttccggatagcaattatctaaacgtaacacttgacaactgtgtgaggaaaagcgtatttgcgcacgcgaccagaatgtaaattaaccagttacttactttactacaatgtaaccggcagtgattttttaagagccatgccttcagcagaaatttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttctgcgccgtattttacttcgcttttcagcgagctatagcctgacagttctgaaattgattcattaaggatagcctctttcgtcaacctgttagcccaaagcgtgttgacgcaaataaatgcgccgctctggctttgagttaattcccaggtgtgtgggtatttccgtttggtgttgtctgaagtcgaataccagacggtatcgccaggcgttgcacaaccggtcatcgcacccgtattcgggcagtgtagcgttaattcgcgaccatcgggtgtgatcacatcggctaaaaaacgtttgtaacgctgaattagcgtcgcgcgctgtagagggggagaaaattccattgcgacaatccttgttattgcgttagcgcccagcgttttagcggcgtgtagcgtgtgcgtccacgggcaaacgaggaggcgtaaagggtgaactccgtcaccgcatacgaccagttaaaacctggcggcgggattgtcaccgcctcgctggcgtcgcgcaataaggtaatatgtggatgaaacggacgattgctttgaaaacaaccgctgcgggcagcctgtgaacggagcatattcgccagctggattaagccgcgtggcggctgacgcatccctaaccacaccacacgcgaacgcagccattgtccggcgtcatcaagcgtgagtgtgaaaccaggttgacgaatccgtccggctaaaagagaaagcgccttctctttctcggcgctcacttcgcctaaaaatgccagagtcagatgcaaattatcggcggcgaccggacgtcccgcctcaggtgggaagtgtgtggcgcgccaatggataatctgttcgcggatttctgcaggtaagtcgatagcaaagaacagacgttgcggttcagacatgtgaggcactcggttatgaattaccgcgatgctacaatgtggcgcgaagaatgttaaccctctggagcgttttgtgtcgtcgttgcccgttgctgccgtcttacctgaattacttaccgctctcgattgtgcgccgcaggtattattaagtgcgccgaccggggccgggaaatcaacctggctgccgctgcaactgctggcgcatcccggcattaacgggaaaattatcctgctggagccgcgtcgtctggcggcgcgtaacgtcgcgcaacggctggcggagctgcttaacgaaaagccaggcgataccgttggctaccggatgcgtgcgcaaaactgcgtcgggccgaatacccgcctggaagtggttaccgaaggcgtgctgacgcgcatgatccagcgtgacccggaactgagcggtgttggactggtgatccttgatgaatttcatgagcgcagcttgcaggcggatttggcgttggcgctgttactcgatgtgcaacaaggtctgcgtgatgaccttaaactgctgattatgtcggctaccctggacaacgaccgcttgcagcaaatgctgccagaagcgcctgtcgtcatctcagaagggcgctcgtttccggttgaacgccgttatttaccgctgcccgcgcatcagcgttttgacgatgccgttgcggtagccaccgctgaaatgctgcgtcaggaaagcggatcattactgttatttttacctggcgtcggagaaattcagcgtgtgcaggaacaactggcttcgcgcatcggcagtgatgtattgctctgcccgctgtatggcgcgttgtcgctgaacgatcagcgaaaagcgatcctcccggcaccgcaagggatgcgcaaagtggtgctggcgaccaatattgctgaaaccagtttaaccattgaaggtattcgtctggtggtggattgtgcccaggagcgtgtggcgcgttttgatccgcgcacggggcttacgcgactgattactcaacgcgttagccaggcatccatgacgcagcgtgccgggcgcgccgggcgtctggagccgggtatcagcctgcatttaatcgccaaagaacaagcagaacgcgccgcggcgcaaagtgaaccggagatcttacaaagcgatctttccggtttgctgatggaattactgcaatggggatgcagcgatccggcgcagatgagctggctggatcaaccgccagtagtgaatctactggccgcgaaacgtctgttacaaatgctgggggcactggagggtgaacggcttagtgcgcaagggcaaaaaatggcagcgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaaccagcctggcagcaacgtagtcagcaactgttaaaacgcttaaacgtacgtggcggtgaggcagacagttcgcttatcgcgccgctacttgccggggcgtttgccgatcgcattgctcgtcgccgtgggcaagatggacgctatcaactggcaaacggcatgggagcgatgctcgatgccaacgacgcgctaagccgccacgaatggttgatcgcaccgttattattgcagggcagcgcctcgccggatgcgcggattttactggcgctgctggtcgatattgatgagttagtacaacgctgcccgcagctggtacagcagtctgacactgtggagtgggatgacgcgcaaggtacgctgaaagcctggcgtcggctacaaatcggtcagttgacggtgaaagtgcagccgctggcgaaaccgtcagaagacgagttgcatcaggcgatgcttaatggcatccgtgataaaggtttaagcgtgctcaactggacggcggaagcggaacagctacgcttgcgtttgttatgcgccgcaaagtggttgccggaatatgactggccagcggttgatgatgaaagtttattggcagcgctggaaacgtggctgctgccacatatgactggcgtacattcactacgcggcctgaaatcactcgacatttatcaggcactacgcggattacttgattggggaatgcagcaacgtctggatagtgaattgcctgcgcattacactgtgccgacgggaagccggatcgccattcgttatcatgaagataacccgcccgcgctggcggtgagaatgcaagagatgtttggcgaggccaccaatccgacgatcgcccaggggcgcgtgccgctggtgctggagttgctttcacctgcccaaaggccattacaaatcacacgagatttgagcgacttctggaaaggagcgtaccgtgaggtgcaaaaagagatgaaagggcgttatcccaaacatgtctggccggacgacccggcaaatactgcaccgacgcgacggacgaaaaagtattcgtaaggttggttttctccctctccctgtgggagagggccggggtgagggcatcagcgcgcacgttcaccctcaccctaaccctctccctcaagggagaggggaccgatcgagcacaaattttgagagatatcttcttctgtcttgtaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctactgctaaaactggctatcgtttttgccgtgctgatcgccatttacggcgtttatctcgatcaaaaaattcgtagccgtattgatggcaaggtctggcaactgcctgcggcagtttatggccgaatggtcaatcttgagccagacatgaccatcagcaagaacgagatggtgaagctgctggaggcgacccagtatcgtcaggtgtcgaaaatgacccgtcctggcgaatttaccgtgcaggccaacagcattgagatgattcgccgtccgtttgatttcccggacagtaaagaaggacaggtgcgcgcgcgtctgacctttgatggcgatcatctggcgacgatcgtcaatatggagaacaaccgtcagttcggtttcttccgtcttgatccgcgtctgatcaccatgatctcttcgccaaacggtgagcagcgtctgtttgtgccgcgcagtggtttcccggatttgctggtggatactttgctggcgacagaagaccgtcatttttacgagcatgatggaatcagtctctactcaatcggacgtgcggtgctggcaaacctgaccgccggacgcacggtacagggtgcgagtacgctgacgcaacagctggtgaaaaacctgttcctctccagcgagcgttcttactggcgtaaagcgaacgaagcttacatggcgctgatcatggacgcgcgttacagcaaagaccgtattcttgagctgtatatgaacgaggtgtatctcggtcagagcggcgacaacgaaatccgcggcttcccgctggcaagcttgtattactttggtcgcccggtagaagagctaagcctcgaccagcaggcgctgttagtcggtatggtgaaaggggcgtccatctacaacccgtggcgtaacccaaaactggcgctggagcgacgtaatctggtgctgcgtctgctgcaacagcaacagattattgatcaagaactctatgacatgttgagtgcccgtccgctgggggttcagccgcgcggtggggtgatctctcctcagccagcctttatgcaactggtgcgtcaggagctgcaggcaaaactgggcgataaggtaaaagatctctccggcgtgaagatcttcactacctttgactcggtggcccaggacgcggcagaaaaagccgccgtggaaggcattccggcactgaagaaacagcgtaagttgagcgatcttgaaactgcgattgtggtcgtcgaccgctttagtggtgaagttcgtgcgatggtcggaggttctgagccgcagtttgcgggctacaaccgtgcgatgcaggcgcgtcgttcgattggttcccttgcaaaaccagcgacttatctgacggccttaagccagccgaaaatctatcgtctgaatacgtggattgcggatgcgccaattgcgctgcgtcagccgaatggccaggtctggtcaccgcagaatgatgaccgtcgttatagcgaaagcggcagagtgatgctggtggatgcgttgacccgttcgatgaacgtgccgacggtaaatctggggatggcgctggggctgcctgcggttacggagacctggattaaactgggcgtaccgaaagatcagttgcatccggttccggcaatgctgctgggggcgttgaacttaacgccaatcgaagtggcgcaggcattccagaccatcgccagcggtggtaaccgtgcaccgctttctgcgctgcgttcggtaatcgcggaagatggcaaagtgctgtatcagagcttcccgcaggcggaacgcgctgttccggcgcaggcggcgtatctgacactatggaccatgcagcaggtggtacaacgcggtacgggtcgtcagcttggggcgaaatacccgaacctgcatctggcagggaaaacagggactaccaacaataacgtagatacctggtttgcgggcattgacggcagcacggtgaccatcacctgggtcggccgtgataacaaccagccgaccaaactgtatggtgccagcggggcaatgtcgatttatcagcgttatctggctaaccagacgccaacgccgctgaatcttgttccgccagaagatattgcagatatgggcgtggactacgacggcaactttgtttgcagcggtggcatgcgtatcttgccggtctggaccagcgatccgcaatcgctgtgccagcagagcgagatgcagcagcagccgtcaggcaatccgtttgatcagtcttctcagccgcagcaacagccgcaacagcaacctgctcagcaagagcagaaagacagcgacggtgtagccggttggatcaaggatatgtttggtagtaattaacatctaagcgtgaaataccggatggcgagttgccatccggtaaaataacatcccatctaagatattaaccctttcttttcatctggttgtttattaacccttcaggaacgctcagattgcgtaccgcttgcgaacccgccagcgtttcgaatattatcttatctttataataatcattctcgtttacgttatcattcactttacatcagagatataccaatggcgcgttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggcctgctgcaactattgcggcgcgacagtctgctaccggcactaaaaccgatacgccgattcaaaaagtgccacagtctatttctgttgtgaccgccgaagagatggcgctgcatcagccgaagtcggtaaaagaagcgcttagctacacgccgggtgtctctgttggtacgcgtggcgcatccaacacctatgaccacctgatcattcgcggctttgcggcagaaggccaaagccagaataactatctgaatggcctgaagttgcagggcaacttctataacgatgcggtcattgacccgtatatgctggaacgcgctgaaattatgcgtggcccggtttccgtgctttacggtaaaagcagtcctggcggcctgttgaatatggtcagcaagcgtccgaccaccgaaccgctgaaagaagttcagtttaaagccggtactgacagcctgttccagactggttttgactttagcgattcgttggatgatgacggtgtttactcttatcgcctgaccggtcttgcgcgttctgccaatgcccagcagaaagggtcagaagagcagcgttatgctattgcaccggcgttcacctggcgtccggatgataaaaccaattttaccttcctttcttacttccagaacgagccggaaaccggttattacggctggttgccgaaagagggaaccgttgagccgctgccgaacggtaagcgtctgccgacagactttaatgaaggggcgaagaacaacacctattctcgtaatgagaagatggtcggctacagcttcgatcacgaatttaacgacacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacaccctgctgaccggtgtcgactttatgcgtatgcgtaatgacatcaacgcctggtttggttacgacgactctgtgccactgctcaatctgtacaatccggtgaataccgatttcgacttcaatgccaaagatccggcaaactccggcccttaccgcattctgaataaacagaaacaaacgggcgtttatgttcaggatcaggcgcagtgggataaagtgctggtcaccctaggcggtcgttatgactgggcagatcaagaatctcttaaccgcgttgccgggacgaccgataaacgtgatgacaaacagtttacctggcgtggtggtgttaactacctgtttgataatggtgtaacaccttacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatctcactaaaaccaacaacctgatggcggaccctgagggttccttcttctcggttgaaggtggcgagatccgcgcacgtggcgtagaaatcgaagcgaaagcggcgctgtcggcgagtgttaacgtagtcggttcttatacttacaccgatgcggaatacaccaccgatactacctataaaggcaatacgcctgcacaggtgccaaaacacatggcttcgttgtgggctgactacaccttctttgacggtccgctttcaggtctgacgctgggcaccggtggtcgttatactggctccagttatggtgatccggctaactcctttaaagtgggaagttatacggtcgtggatgcgttagtacgttatgatctggcgcgagtcggcatggctggctccaacgtggcgctgcatgttaacaacctgttcgatcgtgaatacgtcgccagctgctttaacacttatggctgcttctggggcgcagaacgtcaggtcgttgcaaccgcaaccttccgtttctaatttctcttttggggcacggatttccgtgcccatttcacaagttggctgttatgcaggaatacacgaatcattccgataccacttttgcactgcgtaatatctcctttcgtgtgcccgggcgcacgcttttgcatccgctgtcgttaacctttcctgccgggaaagtgaccggtctgattggtcacaacggttctggtaaatccactctgctcaaaatgcttggccgtcatcagccgccgtcggaaggggagattcttcttgatgcccaaccgctggaaagctggagcagcaaagcgtttgcccgcaaagtggcttatttgccgcagcagcttcctccggcagaagggatgaccgtgcgtgaactggtggcgattggtcgttacccgtggcatggcgcgctggggcgctttggggcggcagatcgcgaaaaagtcgaggaagctatctcgctggttggcttaaaaccgctggcgcatcggctggtcgatagtctctctggcggcgaacgtcagcgggcgtggatcgccatgctggtggcgcaggatagccgttgtctgttgctcgacgaaccgacctcggcgctggatatcgcccaccaggttgatgtgctgtcgctggtgcaccgtttaagtcaggagcgtggcctgacggtcattgccgtgttgcacgatatcaatatggcggcacgctactgtgattatctggtcgccctgcgcggcggtgaaatgattgctcagggaacgcctgcggaaattatgcgcggcgaaaccctcgaaatgatttatggcatcccgatgggtattttgccgcatccggcgggtgctgcacctgtgagttttgtttattgatgagcggcttacctcttatttcgcgccgtcgactgttaacggcgatggcgctttctccgttgttatggcagatgaataccgcccacgcggcggctattgatcccaatcgtattgtggcgctggagtggttgccggtggaattactgctggcgctcggcatcgtgccttacggcgtggcggataccatcaactatcgcctgtgggtcagcgaaccaccattgccggactcagtgatcgacgtcggtttgcgcacagaacctaaccttgaactgctgaccgaaatgaaaccatcgtttatggtctggtcggcaggatatggcccttcaccagaaatgctggctcgtattgcgccgggtcgcggatttaacttcagtgacggcaaacagccgttggcgatggcgcgtaaatcgctgacggaaatggcagatttacttaacctgcaaagcgcagcggaaacgcatttagcgcaatatgaagactttatccgcagcatgaaaccccgctttgtgaagcgtggtgcgcgtccgttattgctgacgacgcttatcgatccgcgccatatgctggtcttcggtccaaacagcttgttccaggaaattcttgatgagtacggcatcccaaatgcctggcaaggggaaaccaacttctggggcagtaccgccgtcagtatcgatcgtctggcggcgtataaagacgttgatgtgctctgttttgatcacgacaacagcaaagacatggatgcgctaatggcaacgccgctgtggcaggccatgccgtttgtccgcgccggacgctttcagcgcgtacctgcagtctggttttatggtgcgacgctctcggcaatgcactttgtgcgcgttctggataacgccatcggaggtaaagcgtgagtaaacgaattgcgcttttcccggcgttattgctggcgctgttagtgattgtcgctacggcgctcacctggatgaacttctcgcaggcgctgccgcgtagccagtgggcgcaggctgcctggtcgccggatattgacgtcatcgagcagatgatttttcactacagcttgttgccgcgtctggcgatttcgctgctggtgggcgcgggtctggggctggtgggcgtgctgtttcagcaagtgctgcgtaacccgctggcggagccgacgacgcttggcgttgctacaggcgcgcaactggggattaccgtcactacgctctgggcgatccctggtgcgatggcgagccagtttgctgcgcaggcaggggcttgtgttgttggcttaattgtctttggcgtcgcgtgggggaaacggctgtcgccggtaacgctgattctcgcggggttggtagtgagcctttattgcggcgcaatcaatcagttactggttatcttccatcatgaccaactgcaaagcatgtttctgtggagcactggaacgctgacgcaaaccgactggggcggcgttgagcgtttatggccgcagctgctgggcggtgtgatgctgacgttgctgctacttcgtccgttaaccctgatggggcttgatgatggcgtggcgcgcaatctcgggctggccttgtcgcttgcgcgtctggcagcgctgtcgctggcgattgtcatcagtgcgctgctggtgaacgctgtggggattatcggctttatcgggttgttcgcgccgctgctggcaaaaatgctgggggcgcggcgtctgctgccacgactgatgctggcgtcgttgattggtgcgctgatcctctggctttccgatcaaatcatcctctggctgactcgcgtgtggatggaagtgtccaccggttcggtcactgcgttgatcggtgcgccgctgctactgtggctgttgccgcgtttacgcagcattagcgcgccggatatgaaggtcaacgatcgtgtcgcggctgaacgccaacatgtgctggcgtttgccctcgcgggcggcgtgctgctgttgatggctgtggtggtggcgctgtcgtttggtcgtgatgcgcacggctggacgtgggcgagcggggcgttgctcgaggatttaatgccctggcgctggccgcgaattatggcggcgctgtttgcgggcgtcatgctggcggtggcgggctgtattattcagcgactgaccggaaacccgatggcaagcccggaagtgctggggattagctccggcgcggcgtttggcgtggtgttgatgctgtttctggtgccgggtaatgcctttggctggctgttacctgcaggcagtctcggcgcggcggtgacgctgttgatcattatgatcgccgccggccgcggtggattttccccacaccgtatgttactggcggggatggcgttaagcaccgcgttcaccatgcttttgatgatgttgcaggcaagtggtgacccgcgaatggcgcaagtgctgacctggatttccggttcgacctacaacgcgaccgatgcgcaggtctggcgcaccggaattgtgatggtgattttgctggcgattaccccgctgtgccgccgctggctgaccattttaccgctgggtggtgataccgcccgagccgtaggaatggcgctgacgccgacgcgaattgcgctgctgctgttagcggcttgcctgacggcgaccgcgacgatgactattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatcccggcggggctgctgtcaacctttatcggcgcgccatattttatctatttgttgagaaagcagagccgttaatttttccatataacggccctgtacgcctggacggataaagcgtttacgcgacaacggatgcccgatgcgacgctggcgcgtcttatcgggcctacaaacggccccgaatcgtaggtcggataaggcgttcacgccgcatccgacaaaccatgctggatcacaacttcgcaaacacccgacgtgcagcatcgatggtgttattgatatcttccatgctgtgcgccacggacataaagcccgcttcaaacgctgacggtgccaggtaaacaccttcgtccagcatcatatggaagaaacgcttaaagcgttccacgtcacaggccatcacatcctgatagcacgtcacggactcggcgtcggtaaagaaaataccgaacatgccgccaacgtggttaacgaccagcggaattccggcttcttctgccgcttccagcagaccttctgccagacgtgttgtcagctcatccagcgtttcgtgaacgcccggctgcgcgacttcattcagacaggcgaaacccgctgccatcgcaatcgggttaccggaaagcgtacccgcctgatagaccggacccgtcggggccagcgcatccattacatcacgacgaccaccgaatgcgcctaccggcattccaccgccgatgattttgccgaggcaggttaaatctggcactacgccgtaataatcctgtgcgccagctagcgctacgcggaaaccggtcatcacttcatcgatgatcagcaacgcgccaaattcgtcgcacagcgcgcgcagacctggcaggaactctggcagcggcggaacacagttcatattgcctgccaccggctcgacgataatacaggcaatctcttgcgggtattgctcaaatgcggcgcgtacagaagccagatcattataagtacaggttaaggtatatttggcgaaatctgccggaacgcccggcgagtttggctggcctaacgtgagtgcgccagaaccggctttcaccagcaggcagtcagcgtgaccatggtaacacccttcaaatttaataattttgtcgcgaccggtaaaaccacgggccaggcggatggcgctcatggtcgcttcagtgccggagttcaccatgcgcaccatatccatggtcgggaccagttcggtcaccagttgcgccattttcacttccatttcggttggtgcaccaaagcttaaaccacgctcggcggcttcaatcacggcattgcggattgccggatggttatggcccagcaccatcggcccccaggaaccgacataatcgatataggctttgccatcaacatcgtacagataagcgccgtccgctttttcgataaacagtggagtgccgcccacgccagtaaaggcgcgaacaggggagttcacaccgccagggatcagctcgcgcgctgcgctgtaaagattttcagacttactcatggagggttcctgattcgtagaaaaagtgaatggctgctattctatgttattcataacaagttaaatactcgtcaaacatcaggctgcttgtactggtgcaatcctgatttcttagagtataaaagttttgtgcatttgaaacattacgctttgcaaaggattttcatggaacgtgcgagtaaaatgccgtcatcttatttgtatgaccaataagtgatcattggatgaaaactgatactccctctttagaaacaccgcaggccgcgcgcctgcgacgcagacaactgattcgccaacttcttgagcgcgataaaaccccgttagccattttgtttatggcggcagtcgtcggcacgcttgttgggctggcagcggttgcttttgacaaaggtgtcgcctggttgcagaaccaacgtatgggggcgctggtacatactgctgataattatccgcttctgttaaccgtcgcttttctctgttcggcggtgctggcgatgtttggctactttttggtgcgcaaatacgcgccggaagcaggtggttcggggatcccggaaattgaaggggcgctggaagatcaacgtcccgttcgctggtggcgtgtattgccggtgaagttctttggcgggctggggacactcggcggaggcatggtgttggggcgcgaagggccaaccgtgcagatcggcggtaacattggccgtatggtgcttgatattttccgcctgaaaggtgacgaagctcgccatacgctgctggcaaccggtgctgctgcggggctggctgcggcctttaacgcgccgctggcgggtattttgtttattatcgaagagatgcgtccgcagtttcgctatacgttaatttcgattaaagcggtatttattggtgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggcggcaatattaccaaatgggtgctaatgggcggtgcgattggcggtctgtgtggattgctggggtttgtggcaccagcaacgtcgggcggcggttttaacctgattcctatcgctaccgcggggaatttcagcatgggaatgctggtgtttatcttcgtcgcgcgggtcattaccaccttactctgcttctcttccggcgcgccgggcggtatttttgccccgatgctggcgctgggtactgtgctgggaaccgctttcggaatggttgccgttgagctgtttccgcaatatcaccttgaggcggggacgtttgctattgccggaatgggggcattactggcggcatctattcgcgcgccgttaacggggatcattctggttctggagatgaccgataactaccagctcattttgccaatgattattaccggtcttggcgcaacactattagcgcaatttaccggcgggaaaccgctatactcggcgattcttgcgcgcacgctggcaaaacaggaagctgagcaactggcgcgaagcaaggccgcatcagccagcgagaatacttgaacgaaataccagggtattagataatggcgattattattgggttagaatttgcccaattgccgatgtcgtttggagcaaaatatgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgattataccgaaggtctggaaggttctcgtttcatcgtgaccaacccgaacgcgaaaagcacctgcggttgcggttcttcctttagtatctaatctgttgttcatgtgccggataaactatccggcacatcttctctcttcaacgcccattctcatccagcgcaaacgtcggtagcttaagatgccaacgaatagccgccagccgaatcaatagcgtcacgaccatgcccatcatactggctgtttccagtggtacggaaaatgtgtaataagccgtagcgtggacaataccgccgataatacaggcagttgcgtagatttctgtacgtaaaatcatggggatttcgcgggccagaacatcacgaatgatcccgccgccaacgccagtaatgacgcccatacaaaccgcgattaacggaccggcttccgcattaaaggctttattcacgccaatgccgacaaacaccgccagaccaacggcgtccagcaccggcaacatccattttggtaagcgtcttggctggcgcaccagcacgatggtcagcatgctggtgaccattgcaacgaccagatcggtgggatctttcacccaaaataccgggccgtgatccagcgccatgtcgcgaattgtcccgccgcctactgcggttaccacgcccagtaccagaacaccaaaagggtccatacgcaattttccggctaacaaaacgccggagatggcaaataccgctgtgccgactatatccagccaatagacgagcattgttcaatccccactgagcacctgaaaaggtcaggcgctaatctacctgtgaaagcgcattacagagctgttgtgcagcgaggataatacgtgggcttgcacgttcaaaccagtcactcgtgagaggaataacgggaattttgagctgttcaccccagtattgtttgattttaggaatttggtccggtccgcctgtaatgacaatcgcctgtggcgagcgtgctaacacctgttcgcggctaacttgcggccagggaacccggctgtctttaaagatgttttctccgccacaaacttcgagtacctggttctgaatcgactcttttccactggtaaatggcggattaatgccgaattgcagaaaaacacgttttttaggtttatcagcatattgcgctttcaattgcgcgtactgatccagcagggattgcgcggcttgttcggccttgtctggttgcggactccagggggccagttgacgtaacgcattggcaatttgttcaatgcttgtcgcatcgacccacatcacttttattcccagcgaagccagctggtcaacctgccgctcggcattacctccacgccaggcaatcaccagatcgggtttcagcgcgacaatgcgttccagattcatcccctgccaggtggaaacctgctcaatcttttgcgcttgtggaggatagtcggaatagctgctgaccccaaccggcgtgatcccggcggcaaaggcaagttcagtgttggcgggagaaagcgtgatgacgcgcggcgcggcgttgagccacagtggcgcaagaaaagacagggcgaccagcgccctgaacagtgacttagccatgtgcaagtttctgcaccagtgactcaaccatcaggctggactgtttagcggcaacagccaggaactcatcgaagctaagatgagactgttgatcggccacgtcggagatggcgcgtacgacaacaaacgggacgttgaaattgtggcagacatgggcgattgccgtcgcttccatctctacagcaatggcctgtgggaagttgtggcggattttcgccagaccaacagaaccgttgatgaaagcgtcgccgctaacaatcaggccacgtacagcgttaagattcagttcggcaatgcaggcctcagcggcagcgatcagtttatcgtcagctttaaagcctgccggacagcctggtaactgaccgtattcataaccaaatgccgtgacatccgcgtcgtgataacgtgcttcgtccgagacaacgatatcgcccactttcaacgttggtgccaggccaccggcagaaccggtgttaataatcacatctggcttgcagtgttccaacagcaaagtggcacccagcgccgcagcgactttaccgatgcccgatttcagaagcgcaacctcggttccattcagttggccggtatagatttcgcaaccgccgagactgatagtttgacggttttcgattttgtcacgcagcagcgtaacttcttcttccattgcaccaatgatgccgattttcatagatttactcgcgataagcccgatttgaaggcatagtttaccatgcgcttacggggaagcgtatttctcacgcgggagaggacatggcacagattgatttccgaaaaaaaataaactggcatcgtcgttaccgttcaccgcagggcgttaaaaccgaacatgagatcctgcggatcttcgagagcgatcgcgggcgtatcatcaactctccggcaattcgtcgtctgcaacaaaagacccaggtttttccactggagcgcaatgccgccgtgcgcacgcgtcttacccactcgatggaagtccagcaggtggggcgctacatcgccaaagaaattttaagccgtctgaaagagcttaaattactggaagcatacggcctggatgaactgaccggtccctttgaaagcattgttgagatgtcatgcctgatgcacgatatcggcaatccgccgtttggtcattttggcgaagcggcgataaatgactggtttcgccaacgtttgcacccggaagatgccgaaagccagcctctgactgacgatcgctgcagcgtggcggcactacgtttacgggacggggaagaaccgcttaacgagctgcggcgcaagattcgtcaggacttatgtcattttgaggggaatgcacaaggcattcgcctggtgcatacattgatgcggatgaatctcacctgggcacaggttggcggtattttaaaatatacccgtccggcgtggtggcgtggcgaaacgcctgagacacatcactatttaatgaaaaagccgggttattatctttctgaagaagcctatattgcccggttgcgtaaagaacttaatttggcgctttacagtcgttttccattaacgtggattatggaagctgccgacgacatctcctattgtgtggcagaccttgaagatgcggtagagaaaagaatatttaccgttgagcagctttatcatcatttgcacgaagcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctacgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcggcttgaattgcagggctatcgggtcattagcggattattagagatttatcgtcctttattaagcctgtcgttatcagactttactgaactggtagaaaaagaacgggtgaaacgtttccctattgaatcgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataaccaggcttttgtaaagacgaacaataaatttttaccttttgcagaaactttagttcggaacttcaggctataaaacgaatctgaagaacacagcaattttgcgttatctgttaatcgagactgaaatacatgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggaaggttctccgttccagagctctccgttctgccagggtggccagggcggtaatggtggcggccagcaacagaaattcatggcgctgggttccggcgtcatcattgatgccgataaaggctatgtcgtcaccaacaaccacgttgttgataacgcgacggtcattaaagttcaactgagcgatggccgtaagttcgacgcgaagatggttggcaaagatccgcgctctgatatcgcgctgatccaaatccagaacccgaaaaacctgaccgcaattaagatggcggattctgatgcactgcgcgtgggtgattacaccgtagcgattggtaacccgtttggtctgggcgagacggtaacttccgggattgtctctgcgctggggcgtagcggcctgaatgccgaaaactacgaaaacttcatccagaccgatgcagcgatcaaccgtggtaactccggtggtgcgctggttaacctgaacggcgaactgatcggtatcaacaccgcgatcctcgcaccggacggcggcaacatcggtatcggttttgctatcccgagtaacatggtgaaaaacctgacctcgcagatggtggaatacggccaggtgaaacgcggtgagctgggtattatggggactgagctgaactccgaactggcgaaagcgatgaaagttgacgcccagcgcggtgctttcgtaagccaggttctgcctaattcctccgctgcaaaagcgggcattaaagcgggtgatgtgatcacctcactgaacggtaagccgatcagcagctttgccgcactgcgtgctcaggtgggtactatgccggtaggcagcaaactgaccctgggcttactgcgcgacggtaagcaggttaacgtgaacctggaactgcagcagagcagccagaatcaggttgattccagctccatcttcaacggcattgaaggcgctgagatgagcaacaaaggcaaagatcagggcgtggtagtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactcaacattcagcgcggcgacagcaccatctacctgttaatgcagtaatctccctcaaccccttcctgaaaacgggaaggggttctccttacaatctgtgaacttcaccacaactccatacatcttcatcatcctttaggcatttgcacaatgccgtacgttacgtacttccttatgctaagccgtgcataacggaggacttatggctggctggcatcttgataccaaaatggcgcaggatatcgtggcacgtaccatgcgcatcatcgataccaatatcaacgtaatggatgcccgtgggcgaattatcggcagcggcgatcgtgagcgtattggtgaattgcacgaaggtgcattgctggtactttcacagggacgagtcgtcgatatcgatgacgcggtagcacgtcatctgcacggtgtgcggcaggggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacttgttggcgcaggatagccgtttgcgggaagaactggtgatgaacctgattcaggcagaggagaatactcccgcacttactgaatgggcgcaacggctggggatcgatctcaatcaaccgcgagtggtggctattgttgaggtcgacagcggtcagcttggcgtggacagcgcaatggcggagttacaacaactgcaaaacgcgctgactacgcccgagcgtaataatctggtggcgattgtctcgctaaccgaaatggtggtgttgaaaccggcgttgaactcttttgggcgctgggatgcagaagatcatcgtaagcgagttgaacaactgattacccgcatgaaagagtacggccagctgcgttttcgcgtttcactgggcaactattttaccggtcctggcagtattgcccgatcctatcgtacggcgaaaacgacgatggtggtgggtaaacagcggatgccagaaagtcgctgctatttttatcaggatctgatgttacctgtgttactcgacagtttgcgtggcgactggcaggccaacgaactggcgcgaccgctggcgcggctgaaaacgatggacaataacggcttgctgcgacgaacgctggcggcgtggtttcgccacaatgtgcaaccgctggcaacgtcaaaggcgttgtttattcatcgtaataccctggagtatcggcttaatcgtatatcggaactgaccgggcttgatttgggcaattttgatgacaggttgctgctgtatgtggcgttacaactggatgaagagcggtaggttatgcgttaaggttgaggcggcgctggctcattcccctcagcccgaagggtagaggggaatgcccgaattaaccgtcagttcgggattatttacgcgttagtttttccagatcggcttcaatctcgctgatcttattggttacgactgactccaggtgacgtaagtcgtcgaggatcttacgcttaagatcaacttcgctgcggtcacgctggcagatttgatcaagctcatcaatgatataccgtagattcgggctgatttcctggacttctttataaccctgacccacaccatcagcgacgaccgttttacgctgacgcggatatttaaacttaacgctcttggcgaaaaactcgcctttgtctttctggaaatagattttcagaatatcgttgttggcttcctgccggaggctgtaacgatcaatttcttcaggattggtaatacccagacttttcagattgtcgtacatagcgttacctcaaaatgagtcagtaaattgtgcttattttagcatttggcctggcccgcccggctcgactgtgatcgcagaaagcctttttcttccagacttctatcatggcgtaaaaatcaaaaaattacctgctttattctggtgataaaattcacgatctacaccagttccagcatcgttacttccgggcggcagttcagacgcaaaccatacaaactgcccacgccacgggttgtgtagatgtgtctttcgccaaaggcatttaatccggcgacgtaacgtttatcttcgacaggggcaaaaggttcaccaaccaacggtacgcgcagttgcccgccgtgagtatggccgcacagcatcagatcccagggttcatcacgcatgacttctttgctgtcgggattatgcgccagcaccagtcttggcagattggcttcgctggcgggaggcggtttgcattgtccggcccataagtcaccagtgcctaccagttcgaattgcctgttcggcgtggcgatcaccgtagcctggttaaacaacaccgtgatgcccgctgatttcaacgtctcgccaattaagtgatttttttctgtaccaacagggcgatcgtggttgccgaagcaggcaaacgtcggcgcacattcggcaaggggggagagtacgtcactaaacgccgaaaaattcagcgacatatcaaataatacgtaatcgccgcccagtaatatcaaatcgggcttttgttctatgccaagagcaatcgcgtcagaaatcaggcttaaaggaacaaaacgagagtaatggagatcggccagaaaaagaattttgaatggtgctgcgttgtctttaaaaaaggcgaggcggtgacggattaattcaaaccagcctggctcacagtaatgcatataaccgaaacctgagctcgtggctatcgtcgcggcagtagcctgcaaaaatcggcggcgtgaaatcatcgctcatccctgcaaaaaaatcgggcagcgtcgtgctgcccgtgtgcatacttttagtcgatggtacgcagcagttcgttaatgccgactttgccgcgagttttcgcgtcaactttcttaacgataaccgcacagtagaggctgtatttgccatcttttgacggcagattacctgaaacaaccacagaccccgccggaacgcgaccgtagtggatttcgccggtttcacggtcgtaaatacgggtgctctgaccaatgtatacgcccatggaaatgacggaaccttcttcgacaatcaccccttcaaccacttcagagcgcgcgccgatgaagcaattatcttcaatgatggttgggttagcctgcagcggttccagcacgccgccgatgcccacgccaccggaaaggtggacgtttttaccaatctgcgcacaagaaccgacggtcgcccaggtatcaaccatggtgccttcatcaacatatgcgccgatgttgacgtaagacggcatcagcacggtgttacgggcaataaacgcaccctgacgtaccgccgctggtggcacaacgcggaagccttctttctggaaacgtgcttcgtcgtagtcggcgaatttcatcggcactttgtcgaagtagcggctttctgccccttcgatcacctgattatcattaatacggaaagagagcagcaccgcttttttcaaccactgatgcgtcacccactgaccgtcaattttttccgctacacgcagtgcgccggaatccagcagggcgatcacctgatttaccgcttcgcgggtaacggtgtctgcattggctggcgtgatctcggcacggcgttcaaaagcggtttcaataatgttctgtaactgctgcattgttaaactcttttcatatcagtaaacacatcaccctttatcgtttggattgagggcctctgtcaaccgctgatgcacttcctgctgcaactcgttattaagcgcacgccggtcagcggtggcaattatgaataaatcttctactcgctcgccaatggttgtaattcgggcaccatgaagcgaaattcccagatcggcaaaaattttcccgactcgcgccagcagtccaggttggtcgagggcgatcagttcgaggaacgatttgcggtcggtatgggtcggcaaaaacgttacttcggtttcaacagtaaaatggcgtaatttggcgggttggcgacggggctgcggtggctgccagctactttgcgtcagtacttgctccagaccaaaccgaataacctcatgacgatctgcggacagcgggttgccatcgggttccagcacgataaaggtatccatcgccataccgtcgcgagtggtgaaaatttgtgcgtcgtgaacacttaaattgcggcggtctaattcggcacagacggcggcaaacagataagggcggtccgggctccagataaaaatctcggtgcctccacgcgtagcctgcgggctaagcaataccagcggtttgcttaaatcatgctgtaataaatggcgggcatgccaggccagttgatttgggctatggcggacaaaatagttagcacgacagcgtgaccaaatttggtgcagcgcctcttcgtcgatgttatccatgcgcagtagtgccagtgcctggagttggtgatggcgaacccgttcgcgcatatccggcgtgttttgcattccgcgtcgtagctgcttttcggtggcaaagtagagctcacgcaacagactttgcttccagctattccacagcgtttcgttggtggcgcaaatgtcagccacagtcaggcataccagatagcgcagacgattttccgtttgcacttcttcggcaaactgcttgatgacttccgggtcctgaatatcgcggcgttgggcggtcaccgacatcaacaggtgctggcgaaccagccaggcgaccagctgtgtttcgcgtgagttcagcccgtggagttcggcaaaatgcactacatcctgagcaccgagaatggagtggtcgccgccgcgtcctttggcgatatcgtgaaacagcgcggcgatgaaaatcagctcagttgacggcaggcgcggccagacgtccacacacaacggatggcgctggcgcgtttcttcactggcaaaactctccagtttcagcatcacgcggatagtatgttcatccaccgtgtaggcgtggaacagatcaaactgcatctgcccgacgatatgcgaccattgcggcatatacgcgccgagcacgctatggcgatgcattggcaatagcccgcgccgcaccgctccggggtgacgcagaatgctcaaaaacagttttcgtgcttccggaatattacacagcggttgttgcagatggcgacgggcatggcgtaactggcgcagcgtggtggagtaaatgccggtgatcgcactgttgtgcaccatggtgtagaacatacgcaagatggcttccggctggcgcataaatagtgtttcatcacgcaggtcgattagcgtaccgcgtagctgaaactcatcgtcgattggacgtggtttttcgtcggcgggaagggcgaggatggcttcatcgaacagttgcagcagcatctggttgagttcactgacgcggcgtgtaacgcggaagtaatccttcatcatccgctcgaccggttcgttaccttcaccactgtaattcagacgctgggcgacgctaagctggcgatcgaataacaggcgattatcgtaacggctgacgaccagatgcagggcaaagcgaatacgccacaatatatgcagacattcgtttaattccgcccgctccgctgaggttaagaagccaaacccgaccatttcatccagcgatgttgcgccaaaatgacggcgggccacccattgcagagtgtggatatcgcgcaagccgccagggctgcttttgatgtctggttcaaggttgtagctggtgccatggtaacgctgatggcgctggttctgttcttcaactttcgccgcgtagaacttgtcggaaggccagaatccttcgctgaaaatatgtttttgcagttcgaggaacagcgcaacatcgccaattaataagcgggattcgattaaattggtggcgacggttaaatccgataacccttccagcatgcactcttcaagcgtgcgcacgctatgaccgacttccagctttacatcccagagcagcgttaacagctcgcccactttttgcgcctgatcgtccgggagctttttacggcttaaaatcagtaaatcgacgtctgaaagtggatgcagctcgccacgaccgtagccaccgacggcgaccaatgccaggtcggcaatctggctgaatcccgcttcaatccataatcgttgcaggagctggtcgataaactcggtgcgcgcctcaatcaactgttctgcagagatcccattgtcaaaggcatcacccagccaacgctggaaagtatcgatatgggcttttatcccaccgacggttaattcatcacggggccagacgcatggattttgcggttgaccgggcagggtggggagagcggtgtttgcgtactgttctggaagggtattcattgtgcgccacccataagattaaattatcgcattaaaaaagccggcattcgccggcttcatcttattcgtcgtgcgagattatcgccgggatggtgtcatccttgcgtagcgtcagaatttcgcagccgttatcagtcaccacaatagtatgctcatattgtgcagacaagctgcgatctttggtttttaccgtccagccatctttcatggtgcggatctcttttttacccgcgttgaccattggctcgatggtgaacgtcatcccaggtttcagtacgacgttggtttcacgggagtcatagtgcagcacctgcggttcttcatggaagccgcgaccaataccgtgtccgcaatattcacgaacgacggagaagccttctgcttcgacaaatttctgaatcgccgcaccgatttcgcgcagattaatgcctggttttaccatgcgtagcgccaggtacaggctttcttgcgtgatgcggcacagacgttcgcccatgatggtcggcttaccgacgataaacattttcgaggtatcgccgtggaaaccatctttgattacggtgacatcaatgttaacgatatcgccatctttcagcagcttagcatcgtccgggataccgtggcacaccacttcattaatagagatgcaaacggatttcggatagccgtgatagccgaggcaggcagaaaccgcgtgttgttcattaacaatgtaatcattacagatgcgatccagctcgccggtgctgacgcccggtttaacatacggttcgatcatctccagcacttcggcagccagtcggccagcgacgcgcattttttcgatatcttctggggtcttgattgagatagccattaattctgtccatcagcgtcggtgataccgacaatatatatgtaagtgccgtcaatggtatcacacccgggcaaattgagaatcattctgaatttcgccaaacgtgccactgaaggttttctataatagaaaattcgacgtctgatgctgtacacagcgccaacaattattggtgtccacgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgcgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgacaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaagcaaacaacctgggtattccggtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaataaggcttgataactcccccaaaatagttcgagttgcagaaaggcggcaagctcgagaattcccgggagcttacatcagtaagtgaccgggatgagcgagcgaagataacgcatctgcggcgcgaaatatgaagggggagagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagttctgaaagcacagttcgaagaagaacgtgttgcgctggtagcgaaaattggtgaaaacatcaacattcgccgcgttgctgcgctggaaggcgacgttctgggttcttatcagcacggtgcgcgtatcggcgttctggttgctgctaaaggcgctgacgaagagctggttaaacacatcgctatgcacgttgctgcaagcaagccagaattcatcaaaccggaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcagcagaagttgctgcgatgtccaagcagtcttaattatcaaaaaggagccgcctgagggcggcttctttttgtgcccatcttgtaaattcagctaacccttgtggggctgcgctgaaaagcgacgtacaatgtcgctagtattaattcatttcaatcgttgacagtctcaggaaagaaacatggctaccaatgcaaaacccgtctataaacgcattctgcttaagttgagtggcgaagctctgcagggcactgaaggcttcggtattgatgcaagcatactggatcgtatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttaccgctgatccggcgaaagatccaaccgcaaccatgtacgagcaactgacttacagcgaagtgctggaaaaagagctgaaagtcatggacctggcggccttcacgctggctcgtgaccataaattaccgattcgtgttttcaatatgaacaaaccgggtgcgctgcgccgtgtggtaatgggtgaaaaagaagggactttaatcacggaataattcccgtgatggataaataagggtaagattccgcgtaagtatcgcgggggcgtaagtctggttataaggcgttattgttgcaggcagtttggtcacggccagcgcgcagcaaccggagcgtacaaaagtacgtgaggatggcgagcactgcccggggccaaaatggcaaataaaatagcctaataatccagacgattacccgtaatatgtttaatcagggctatacttagcacacttccactgtgtgtgactgtctggtctgactgagacaagttttcaaggattcgtaacgtgattagcgatatcagaaaagatgctgaagtacgcatggacaaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtacactgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaacgtgcgtcgtgacgcgaacgacaaagtgaaagcactgttgaaagataaagagatcagcgaagacgacgatcgccgttctcaggacgatgtacagaaactgactgatgctgcaatcaagaaaattgaagcggcgctggcagacaaagaagcagaactgatgcagttctgatttcttgaacgacaaaaacgccgctcagtagatccttgcggatcggctggcggcgttttgctttttattctgtctcaactctggatgtttcatgaagcaactcaccattctgggctcgaccggctcgattggttgcagcacgctggacgtggtgcgccataatcccgaacacttccgcgtagttgcgctggtggcaggcaaaaatgtcactcgcatggtagaacagtgcctggaattctctccccgctatgccgtaatggacgatgaagcgagtgcgaaacttcttaaaacgatgctacagcaacagggtagccgcaccgaagtcttaagtgggcaacaagccgcttgcgatatggcagcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgccatttttcagagtttaccgcaacctatccagcataatctgggatacgctgaccttgagcaaaatggcgtggtgtccattttacttaccgggtctggtggccctttccgtgagacgccattgcgcgatttggcaacaatgacgccggatcaagcctgccgtcatccgaactggtcgatggggcgtaaaatttctgtcgattcggctaccatgatgaacaaaggtctggaatacattgaagcgcgttggctgtttaacgccagcgccagccagatggaagtgctgattcacccgcagtcagtgattcactcaatggtgcgctatcaggacggcagtgttctggcgcagctgggggaaccggatatgcgtacgccaattgcccacaccatggcatggccgaatcgcgtgaactctggcgtgaagccgctcgatttttgcaaactaagtgcgttgacatttgccgcaccggattatgatcgttatccatgcctgaaactggcgatggaggcgttcgaacaaggccaggcagcgacgacagcattgaatgccgcaaacgaaatcaccgttgctgcttttcttgcgcaacaaatccgctttacggatatcgctgcgttgaatttatccgtactggaaaaaatggatatgcgcgaaccacaatgtgtggacgatgtgttatctgttgatgcgaacgcgcgtgaagtcgccagaaaagaggtgatgcgtctcgcaagctgaggataatccggctacagagagtcgcgctatttgttagcgtagggcttcagtgatatagtctgcgccatctgatcgtaagtagttggctttataaggtcagatatgccgtggttttacacggcttttttttgtataggcttcagtattcctgagtaccgtaaaccctgtcagggaataaaaaacgcgtgatgttgtctgctactcaaccacttagcgaaaaattgccagcgcatggctgccgtcatgttgcgatcattatggacggcaatggccgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctcgatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccattgtaacgctggtggtctgcatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgccttatttttggcgtgctaaccattgttcccttcttctggggcatgctggcgttacgggcctggcactatgacgagaatcattacagtggcgcaatatggctgctctatgtcatgatcctggtatggggcgctgactccggcgcatatatgtttggcaaattgtttggtaaacataagctggcaccgaaggtttctccgggtaaaacctggcaaggctttatcggtggactcgctactgcagcggtaatctcatggggttatggcatgtgggcgaatctcgacgtcgctcccgtcaccttactcatttgctctattgtcgcagcgttagcctcagtgctcggcgatctgaccgagagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgcaggtccggttgcaaacttcatttttgctatctttgcctactggctggtttttattattggtgtgcctggcgtacgtccggtggttggcgaaatagcagccaattcgatagctgcggaagcacaaattgcaccaggtacggaactaaaagccgtagatggtatcgaaacgcctgattgggatgccgtgcgtttgcagttggtcgataaaattggcgatgaaagcaccaccattacagtagcgccatttggcagcgaccaacggcgggatgtaaagctcgatttacgtcactgggcgtttgagcctgataaagaagatccggtatcttcgctggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaatggtaaagcgattggttttgtcggtattgagccgaaagtcattcctttgccagatgagtataaagttgtacgccagtatgggccgttcaacgccatcgtcgaagccacggacaaaacgtggcagctgatgaagctgacggtcagtatgctgggaaaattgatcaccggtgatgtgaaactgaacaacctcagtgggccgatctctatcgccaagggggctgggatgacagcggaactcggggttgtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatgagagttagttaggaagaacgcataataacgatggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacacggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgtaaaagctgtcgtgaccccgctgccgcgcaaccgtgttgacctaaaactggtgttccaggaaggtgtgtcagctgaaatccagcaaattaacattgttggtaaccatgctttcaccaccgacgaactgatctctcatttccaactgcgtgacgaagtgccgtggtggaacgtggtaggcgatcgtaaataccagaaacagaaactggcgggcgaccttgaaaccctgcgcagctactatctggatcgcggttatgcccgtttcaacatcgactctacccaggtcagtctgacgccagataaaaaaggtatttacgtcacggtgaacatcaccgaaggcgatcagtacaagctttctggcgttgaagtgagcggcaaccttgccgggcactccgctgaaattgagcagctgactaagatcgagccgggtgagctgtataacggcaccaaagtgaccaagatggaagatgacatcaaaaagcttctcggtcgctatggttatgcctatccgcgcgtacagtcgatgcccgaaattaacgatgccgacaaaaccgttaaattacgtgtgaacgttgatgcgggtaaccgtttctacgtgcgtaagatccgttttgaaggtaacgatacctcgaaagatgccgtcctgcgtcgcgaaatgcgtcagatggaaggtgcatggctggggagcgatctggtcgatcagggtaaggagcgtctgaatcgtctgggcttctttgaaactgtcgataccgatacccaacgtgttccgggtagcccggaccaggttgatgtcgtctacaaggtaaaagagcgcaacaccggtagcttcaactttggtattggttacggtactgaaagtggcgtgagcttccaggctggtgtgcagcaggataactggttaggtacaggttatgctgttggtatcaacgggaccaaaaacgattaccagacctatgctgaactgtcggtaaccaacccgtacttcaccgtagatggcgtaagcctcggtggtcgtctcttctataatgacttccaggcagatgacgccgacctgtccgactataccaacaagagttatggtacagacgtgacgttgggcttcccgattaacgaatataactcgctgcgtgcaggtctgggttatgtacataactccctgtccaacatgcagcctcaggttgcgatgtggcgttatctgtactctatgggtgaacatccgagcacctctgatcaggataacagcttcaaaacggacgacttcacgttcaactatggttggacctataacaagcttgaccgtggttacttcccgacagatggttcacgtgtcaacctgaccggtaaagtgaccattcctggatcggataacgaatactacaaagtgacgttagacacggcgacttatgtgccgatcgatgacgatcacaaatgggttgttctggggcgtacccgctggggttatggtgatggtttaggcggcaaagagatgccgttctacgagaacttctatgccggtggttccagcaccgtgcgtggcttccagtccaataccattggtccgaaagcagtttacttcccgcatcaggccagtaattatgatccggactatgattacgaatgtgcgactcaggacggcgcgaaagacctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaagtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaacatgggcagcctgttccagcaggtagcgcagaaaaccggtgtttctaacacgctggaaaatgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaacgccgttgcttacaacagcagcgatgtaaaagacatcactgccgacgtactgaaacaggttaaataagtaatgccttcaattcgactggctgatttagcgcagcagttggatgcagaactacacggtgatggcgatatcgtcatcaccggcgttgcgtccatgcaatctgcacaaacaggtcacattacgttcatggttaacccaaaataccgtgagcatttaggcttgtgccaggcgtccgcggttgtcatgacccaggacgatcttcctttcgcgaaaagtgccgcactggtagtgaagaatccctacctgacttacgcgcgcatggcgcaaattttagataccacgccgcagcccgcgcagaacattgcacccagtgcggtgatcgacgcgacggcgaagctgggtaacaacgtatcgattggcgctaacgcggtgattgagtccggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgcctgatccagtccggaacagtggtaggcgcagacggctttggttatgccaacgatcgtggtaactgggtgaagatcccacagattggtcgcgtaattattggcgatcgcgtggagatcggtgcctgcacaaccatcgatcgcggcgcgctggatgacactattattggcaatggcgtgatcattgataaccagtgccagattgcacataacgtcgtgattggcgacaatacggcggttgccggtggcgtcattatggcgggcagcctgaaaattggtcgttactgcatgatcggcggagccagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaacgttccatcttttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgatggtaaagtagtttgcgaagcaacgatgatgtgtgctcgtagccgggaggcctgatacgtgattgataaatccgcctttgtgcatccaaccgccattgtggaagagggcgcgtcaattggcgcgaacgcacacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgtgtggaaatcggcgatcgtaaccgcattcgcgaaagcgtcaccattcatcgtggcacagtccagggcggtggattgacgaaggtgggcagcgacaacttactgatgatcaacgcgcacattgcgcacgattgtacggtaggtaaccgctgtattctcgccaacaacgcaacgctggcgggtcacgtatcggttgacgacttcgcgatcatcggcggcatgaccgcagtccatcagttctgcatcattggtgcgcacgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaatgactgaacagcgtccattaacgattgccctggtcgccggagaaacctccggcgatatcctgggggccggtttaatccgcgctctgaaagaacatgtgcccaacgcccgctttgttggtgttgccgggccacgaatgcaggctgaaggctgcgaagcctggtacgaaatggaagaactggcggtgatgggcattgttgaagtgctcggtcgtctgcgtcgcttactgcatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtcagtctgggcgtggcgacagaaacgtgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatgccgcccgtgatgtgctggggatccctcacgatgcccactgcctggcgttgctaccggggagccgtggtgcagaagttgaaatgcttagtgccgatttcctgaaaacggcccagcttttgcgccagacatatccggatctcgaaatcgtggtgccactggtgaatgccaaacgccgcgagcagtttgaacgcatcaaagctgaagtcgcgccagacctttcagttcatttgctggatgggatgggccgtgaggcgatggtcgccagcgatgcggcgctactggcgtcgggtacggcagccctggagtgtatgctggcgaaatgcccgatggtggtgggatatcgcatgaagccttttaccttctggttggcgaagcggctggtgaaaactgattatgtctcgctgccaaatctgctggcgggcagagagttagtcaaagaattattgcaggaagagtgtgagccgcaaaaactggctgcggcgctgttaccgctgttggcgaacgggaaaaccagccacgcgatgcacgataccttccgtgaactgcatcagcagatccgctgcaatgccgatgagcaggcggcacaagccgttctggagttagcacaatgatcgaatttgtttatccgcacacgcagctggttgcgggtgtggatgaagtcggacgcgggccgttagttggcgcggtcgtcaccgctgcggtgatccttgacccggcgcgcccgattgccgggctgaatgattccaaaaagctgagcgaaaaacgccgtctggcgctctatgaagagatcaaagagaaagcgttgagctggagtctgggccgcgcggaaccccacgaaatcgacgagctgaacattcttcatgcgaccatgctggcgatgcagcgtgccgtcgctgggctgcatattgcgccggaatatgtgttgattgatggtaaccgctgcccgaaattaccgatgcctgcgatggctgtggtgaaaggcgatagccgcgtaccggaaatcagtgccgcgtctatcctggcgaaagtgacgcgtgacgccgaaatggcggcgctggatattgttttcccgcaatatggttttgcccaacacaaagggtacccaaccgcttttcatctggaaaaactggctgaacacggcgcgaccgaacaccatcggcgcagctttgggcctgtcaaacgcgcactgggacttgcgtcctgattcttgtgtcgagattaagtaaaccggaatctgaagatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttccacgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgtccggggcgtttgaccgtcttgggccacatcgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaatacaggaatactatgagtctgaatttccttgattttgaacagccgattgcagagctggaagcgaaaatcgattctctgactgcggttagccgtcaggatgagaaactggatattaacatcgatgaagaagtgcatcgtctgcgtgaaaaaagcgtagaactgacacgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgctttaagatgcctatcatcacctttatcgacaccccgggggcttatcctggcgtgggcgcagaagagcgtggtcagtctgaagccattgcacgcaacctgcgtgaaatgtctcgcctcggcgtaccggtagtttgtacggttatcggtgaaggtggttctggcggtgcgctggcgattggcgtgggcgataaagtgaatatgctgcaatacagcacctattccgttatctcgccggaaggttgtgcgtccattctgtggaagagcgccgacaaagcgccgctggcggctgaagcgatgggtatcattgctccgcgtctgaaagaactgaaactgatcgactccatcatcccggaaccactgggtggtgctcaccgtaacccggaagcgatggcggcatcgttgaaagcgcaactgctggcggatctggccgatctcgacgtgttaagcactgaagatttaaaaaatcgtcgttatcagcgcctgatgagctacggttacgcgtaattcgcaaaagttctgaaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataacttgccagagcggcttccgggcgagtaacgtgctgttaacaaataaaggagacgttatgctgggtttaaaacaggttcaccatattgcgattattgcgacggattatgcggtgagcaaagctttctactgcgatattcttggtttcacgctgcaaagcgaagtctatcgcgaagcgcgcgactcatggaaaggggatttggcgcttaatgggcaatatgtgattgagcttttctcatttccgttcccgccggaacgacccagccgaccggaagcttgcggtctgcgtcatctggcttttagcgttgatgacatcgatgcggcagtggcgcaccttgaaagccataacgtgaagtgtgaaaccatccgtgtcgatccatacacgcaaaaacgcttcaccttctttaacgatccggacgggctgccgttggaactgtatgagcagtaaggcttgtcatcgccgcatttgcccggtaacgtgccgggcattgctactgtaaaatcgcaccatcatgacactcacgctcaatagacaacttctcacctcacgccagattctggtggcctttagcggcgggcttgactccaccgttctgctgcatcagttggtgcagtggcggacggaaaatccgggtgtcgctctgcgcgctattcatgtgcatcacggtttaagtgccaatgccgatgcctgggttacgcattgcgaaaacgtctgccaacagtggcaggtgccgctggtggtcgaacgcgtacaacttgcgcaagaaggactgggcattgaggcccaggcgcggcaggcacgttatcaggcatttgcccgcaccttgttgcccggtgaagtgctggtcaccgcgcaacatctcgacgatcaatgtgaaacctttctgctggcgctaaaacgcggcagtggccctgccgggctttcggctatggcggaagtctcggagtttgccggaacgcggcttattcgcccgttgctcgcccgcacgcggggggaactggtgcagtgggcgcgtcagtatgatttacgctggattgaagacgaaagtaatcaggacgactcatacgatcgtaactttctgcgcctgcgcgtagtgccgttattgcagcagcgttggccgcattttgccgaagcaacggcccgcagcgccgcactttgtgctgaacaagagagcctgctggatgaactgctggcagatgatttagcacactgtcaatcgccgcaggggacgctgcagattgtgccaatgctggcgatgagtgatgcccgccgcgcggcgattatccgccgctggctggcagggcagaatgcaccgatgccttcccgcgacgcgttggtgaggatctggcaggaagtggcgctggcgcgggaagatgcctcaccctgtttacgtttgggcgcgtttgaaatccgacgctatcagtcgcaactgtggtggattaaatccgtcaccgggcaaagcgaaaacattgtgccgtggcagacgtggcttcaaccgctggaattaccggcggggctgggaagtgtacagcttaatgcgggaggcgatattcgccctccgcgtgcagacgaagcggtcagcgtgcgtttcaaagcgccaggattgctgcatattgtcgggcgtaacggcggacgtaagctaaagaaaatctggcaagagctgggcgtgccgccgtggctacgtgacaccacgccactgctgttttatggcgaaacgctgattgcggcggcaggggtatttgtgacgcaagaaggtgtggctgaaggtgagaatggcgtaagttttgtctggcagaaaacgcttagttaagtgaaagccggataagacgcatcaaacgtcgcatccggcgaaagtcaatcaggattcgcttaccaccaccgtaccgatttccgggtggctaaagctggtaattttatccagacgcagctcgcgggtttcgccagcggcctcgacgaccaggtactccacatttttgcgggagactaaatcactggcttttgcctgcaatttttcgccatctttcagctcaagtgtcagcattaaatgatgctggcaggcgagctcaagattatcgtaatcatcacaattgattggttgatacgtatcattcattgacataatcgctcaccagtaagtttgccgcagcgtatgctgctttttccctgacagcctcagaaagggcgtcgtcggcagccatttcattcagcactttcaaaacgcagcccagcgcgtccggaacgtatcctaagtctccgctggcgatttccgcgtaccgcttgcgtattaactcacaatatttttccacatgccctcctgtcagcactctgacttaaccgtggatgcaagtctaagcctacgaagataaactctgtttcgcaaggtgactataccacactcatttctgcaatatcagcgccgcaactgcacgtattccgttacaatggcctcctgattcgaaaggagttttcttatggcgcttaaagcgacaatttataaagcgacggttaatgtggccgatctcgaccgcaaccagtttctcgatgcctctctgacgctggcgcgccatccttcagaaacccaggagcgtatgatgctgcgcttgctggcgtggctgaaatatgctgatgaacgtctgcaatttacccgtggtttgtgtgccgatgatgagccggaagcgtggctgcgtaacgatcacctgggcattgatttgtggattgagctggggctgccggatgagcggcggattaagaaagcctgcacccaggccgcagaagtggcgctgtttacctataatagtcgggcggcgcaaatctggtggcagcaaaatcagagcaaatgtgtgcagtttgccaatctttccgtctggtatctggacgatgaacaactggcgaaagtaagcgcctttgccgatcgtaccatgacgctgcaggcaacgattcaggatggcgtgatctggttatcggatgataagaataatctggaagtgaacttaaccgcctggcaacaaccttcatgattgtgatttcccgacatgttgctattcccgatggtgagcttgagatcaccgccattcgtgcgcagggcgcgggcgggcagcatgttaataagacctcaacggctattcatctgcgttttgacattcgggcgtccagcctgccagagtattacaaagagcgtctgctcgccgccagccatcatttgatcagcagtgatggcgtgattgtcattaaggcacaggaataccgcagtcaggaactgaaccgcgaagcagctctggcccggctggtggctatgattaaagaattaacaacagaaaaaaaagcccgacgacccacgcggcccacccgtgcatcgaaagagcgcaggctggcatcgaaagcacaaaaatcaagcgtgaaggcgatgcgcggcaaagtgcgcagcggtcgggaataaaaagaaggaatggatggtgaaaaaagcgatagtgacagcgatggctgtaatcagcctctttactctgatgggatgtaataatcgggccgaagtcgatacgctttctccggcgcaggctgccgaactgaaaccgatgccgcaaagttggcgcggcgtgctgccgtgtgccgattgcgaaggaatcgaaacctctctgttcctcgaaaaagacggaacatgggtgatgaatgagcgttatctcggtgctcgtgaagaaccttcctccttcgcttcctacggtacatgggcgcgaaccgctgacaagctggtattaaccgacagcaaaggtgaaaagtcatattatcgggcgaaaggcgatgcgctggagatgctcgatcgtgaaggcaatccgattgaatcgcagttcaactatacgctggaagcggcacaatccagtttacctatgacgccgatgaccctgcggggcatgtatttttatatggctgatgcggcgaccttcactgattgcgcgaccggaaaacgtttcatggtagcgaataacgcagagctggagcgtagctacctggctgcgcgcggtcacagtgaaaaaccggtgttactgtcagtagaaggtcactttacgcttgagggtaatccggataccggtgcgccgactaaagtattggcacccgatacggcagggaaattttaccccaaccaggattgcagtagtttggggcagtaacccgtcttgagacagaaacaaacgcaaaacaggccagaaggatatatttcaacattttgaatttgcacgttttttgtaggccggataaggcgtttacgccgcatccggcaatggtgctcaacgcctgatgcgacgctggcgcgtcttatcatgcctacaacccccctcataccttaaggcggataaggcatttactttatcaccgggtcaaaccaacaaagcgacccgccttgatataaatcccaggcttcaggtgcccaacatactgtaactgcgtttctggcttaaacgcagagacatcaccaatacgcatatgcatcagatcggcagggctaatccagcccgattgcgccagtgtaagtggatgcccggctttggcaaaggcatccgtgacaaattccgaacaaaaccacgactttttgtctccttcgcccacactgcttaactgcgctttcgccaggccgctgacgcactgttggcgaaaatcctcggagaacggattcagtgagcacatctggcgagtcaccataaagggaataaattcgacaatgccgcgatagttataaccgctatctttgattttattggcaaacgcggtgatatctgtggcttgttgcggggtaagatccgggactcgtaagacgaaaagcttatcactatgcttcatcgcttttttaagggaaacgatctggacgccagcgcctgtcgcttctgcaacgttattatcacccagaaagattgcaacgtgactcacagaggaagtgctgaagacgcggattccaaatgaggttaccccaaggcttgaggagaacagcaaatcgccgggtttgagatcaggtgccgttatttcttttattgattgttcggtgaaagagctttgatgctggaatttgacagcccatgtttttgcctcggcatctactgctgtggctgatgggtctggctggctgatatcaacggtacaagccgaaagtaaaagaaagctggggagaaacaggcggcagtacgcctttggtttatccattttatacaatccatgtaaaaaaagggccctgaaattcaggaccctttctggcatcagcctttaatctgtttcaccagatattcgacgatgtcaccagtcttaattaactgtttctcgccgttgcgacgatatttatattcgatatcgtcgttgtcgaggttacggtcgcccagcacaatagtgtgcggaataccgatcagttccatatcagcaaacatcacgcccggacgctctttgcggtcatccagcagcacttcgataccttgtgcacgcagttcgctgtacagtttctcagcaagctcttgtacgcggaaggatttgtgcatgttcatcggcagaatcgccacctggaacggcgcgatagcgtcaggccatacgatgcctcgttcgtcgtagttctgctcaatcgccgcagctaccacacgcgttaccccgataccgtagcaacccatcgtcaggatttggttacggccatcttcaccctgtacggaggctttcagtgcttcggagtacttggtacccagctggaagatgtgaccaacttcgataccacgtttgatcagcagcctaccctggccatccgggcttggatcgccagccaccacgttacggatatctgcaacttccggggtagcgacatcgcgatcccagttgatgccgaagtagtgtttaccatcgatgttagcaccagcagcgaaatcactcatcgccgcaacggtacggtcaatcaccaccggaatcggcatgtttaccggacccagtgaacccggaccggctttaaccacggcacgaatttcttcttcggtcgcgaaagtcagcgggcttgcaacctgcggcagtttttctgctttaacttcgttcagctcgtgatcaccgcgcaccagcagcgcaacctgcgggaagctgctgccttcaaccgctttaaccagcagagtcttaaccgttttctcaatcggcagattgaactgttcaaccagttccgcgatggttttcgcgttcggcgtatcaaccagcgtcatttcctgggtagcagcagcgcgcggttctttcggcgcgatagcttctgccagttcaatgttcgctgcatagtcagaggtgtcggagaagaccacatcgtcttcaccgctctgcgccagcacctggaattcgtgagaggcgctgccgccgatagaaccggtgtcggcttgtacggcgcggaaatccagccccatgcggctgaagattttgctgtaggccgcatacattgcatcgtaggtttcctgcagggattcctgagaagtatggaaagagtaagcatctttcatcaggaattcgcgggaacgcatgacgccgaaacgcggacgcacttcgtcgcggaacttggtctggatctgatagaagttcagcggcagctgtttgtaagagctaagctcgttacgaatcaggtcagtgataacttcttcatgagttgggccgagtacgaacggacgctcgccacggtcaacaaaacgcagcagttccggaccgtactgttcccaacgaccactctcttgccacaaatcggctggctgaaccaccggcatcgacacctcgatcgcaccggcgttgttcatctcttcacgcacgatgttttcgacttttttcagaacgcgcacgccggtcggcagccaggtatataacccggaggccagcttgcggatcatcccggcgcgcagcatcagctgatggctgatcacctcggcgtcggcaggtgtctccttgagagtggagagcaggtattggctagtacgcatgttgttacggttccagttggaaggtagaacaggctcaaggcgagcctgggacaaaaaaaagtgatttagtttaccagtgcaaaagaaatgtcaaaagagaagggcgtgaatttaacgcggttccagcgcaaagacttcaaaacctgcgtcggtgacgcgccagcgaacgttaaaatcatgtagccagacggcataggttttgcccgtttcctcacctttacgataggccgggcgcgggtcctgcgccagtacttcgcggataaacagcgttaactgcggataacgcttctccagcgtcaaaagctgcttttcgacctctgcggtaaaactcaccgccatctctgcagctggcgcactttgcgcatagctggcactggcatcgggaagcgattcggcaaaggggagatacggtttgatatccactaccggcgtaccatcgaccagatccagactgccgagcttcagaatcacgctgtctttatggcaaacaacctctttcagctctaccagcgacatgccaattgggttagggcggaaagtagagcgtgttgcgaaaacccccattctggcgttaccgccgaggcgcggtggacgcacagtcggacgccagccgccttccatcgtttgatgaaagacgaaaaggatccataaatggctgaacgcttccaggccgcgaacggcgtcggcctggttgtagggagcaatgagatgcagttcgccgttggcgctttttaccagacctggctggcgcggaacggcgaacttttctttatagggcgagcgaataacgcctatttgctcgaactggaaactgctcatttcgccgtaatgttaagcgcagaaccgatacatacagcctgacgatagcagcctggcgtaccgctggtgacttcgcagctatgcagtaatacagcattggctttcattttagaggcgttgatttgcatccgcttacgtgcggttggaatgctcggcggagagtcctgattagaggcctggcaagagtcgccactgacttcaccgagatcgcggaacggtttgccgactaattcttctgcattggtataaattcggaccggcgtggcgcgcggcgctttcggttttgcaggctccgctttcggctggggtgcagtgctttgaacgggttcgacaggggatctgcttaacatggaacagccgcttagcatgagtgctactaaacagatcggtaaagcacgcatagtatttcctcaatgtatgatcaaaacgtcaatattgaatcaggagcttgtaaaaatgacaagacgggcaagcgcccgtcctgaatgatattacaaattgtggaaacagcctaaaaattaccagcctttaacagctccgccgttaaacactttgtttgctgcttcgtaaacttcgtcagactgataagcctggacgaatttcttcacgttctcggcgtctttgttatcttcacgcgtcacgatcaggtttacgtacggggactctttatcttcaacaaagataccgtctttcgccggagtcaggccaatctggctggcataggtggtattgataactgccagagcgatttgcgcgtcgtccagagaacgcggcagttgcggtgcttccagttcaacaattttcagatttttggggttctcaacaacatcaagaacggtcggcagcaggccaacgccatctttcagtttgatcaagcccactttttgcagcagcagcagtgaacgaccaaggttagttgggtcgtttggcacggcaacctgcgaaccatcctgcagttcatccagtgatttgattttcttggagtaaccagcaatcggataaacaaaagtgttgcctactgcgaccagtttgtagccacgatctttcagttgctgatcaaggtacggtttatgctggaaggcgttggcgtcgatatcgcctttgctcaatgcttcgtttggcagaacatagtcgttgaaggttaccagctcaacgtccaggccatatttgtctttcgcaactttctgcgcgacttctgcaacctgctgttcggcaccaacaatcacgccgactttaatgtggtttggatctttttcatcctgaccgcagcctaccagtgccagtgatccgatcagggctcccactgccgcaaaggttttgaatttgaacgccataccttattccttcttcaattatttatgttgtgttgaacgttacttgcgagtgacagcccggacgatgcggtcgcctgcgaactgaattaaataaaccagaatgaccagcaataccagtaccgtattcatcaccgtcgcgttatagccgatgtagccatactgatagccaatctgacctaaaccaccggcaccgactgcaccacccatcgcggaataaccgaccagggtaatcagggtgatagttgccgcattcaccagacccggcagcgcttccggtaacagcaccttacggacgatctgcatcggcgtggcacccattgcgcgggaagcttcaattaacccggttgggatctccagcagagcgttctcgaccatacgggcaataaacggtgctgcaccaacggttaacggaacaatcgctgcctgcaaaccaatcgatgtaccgacaataacgcgggtaaacggaatcatccatacaagcaagataatgaacgggatggaacggaaaatgttcacaatcgcagaaacggtacgatacagcttcgcgttagcaataatttgccccggacgcgtgacataaagcagaacgccaaccggcagaccaatcacaaagccaaaaaaaccggatacgaaggtcattgccagcgtttcccatacgccacgaaccagcagccacatcatcggctcagacataacccagtacctctacttttacatggtgttcctgcagccaggcaatggcggcttgcgtatcttgttgtgtgccgtgcatttcagtcagcatgatgccgaacttaacgccaccggcgtaatccatctgcgcgctaataatgttgttgttgacgttgaaacgacgcgcggtttcagaaagcagtggggcatcgaccgattgaccggtaaactccagacgcagcatcggcacgcagtcagtaaatggctccgcttgcagacgttcctggtaatcttccgggatatccagatgcagggtcgactgaataaacttctgcgccagcggcgttttcggatgcgagaacacttcacttaccgtgtcctgctcgatcagttctccattgctgatgaccgccacgcaatcacaaatgcgcttcacaacgtccatttcgtgggtgatcaacagaatcgtcaaccccagacggcggttgatgtctttcagcagttcgagaatagaacgtgtcgttgccgggtccagcgcgctggtggcttcatcacacagcaatactttgggattgctggctaacgcacgggcaattgccacacgttgtttctgcccaccggaaagattcgacgggtagctatcatgcttatcgccaagaccaaccaatgacagcaattccgtcacgcgacgtttgacctcgtctttcggtgtgttgtccagctccagcggcagagccacgttgccaaaaacagtacgcgaagagagcaggttaaaatgctggaaaatcataccaatctggcggcgagctttggtcaactcggattctgacagcgtggtcagttcctggccatcgaccagcacgctaccctcggttgggcgctccagcaggtttacacaacgtataagcgtactcttacccgcgcctgaggcaccgataacgccataaatttgtccagctggcacatgcaggctgacgttgttcaacgcctggatggtgcgggtgccctggtggaacactttggtgatattcgaaagttttatcattgattatttattatcgtcattaagttagtcgtggcatctcgaatgcctgaaacgggcaacgccgtcaatgaaatggatgttaaggcatccagacgtctaaatcaatcaggtttatgcgaagagcactttcttgcaggtcgaaacatgcgatactagcgtcacatgccttattaaggagctataaaaggtggcgaagagcgtacccgcaatttttcttgaccgtgatggcaccattaatgtcgatcacggctatgtccatgagatcgacaactttgaatttatcgacggtgttattgacgccatgcgcgagctaaaaaaaatgggctttgcgctggtggtagtaaccaaccagtctggcattgctcgcggtaaatttaccgaagcacagtttgaaacgctgaccgagtggatggactggtcgctggcggaccgagatgtcgatctggatggtatctattattgcccgcatcatccgcagggtagtgttgaagagtttcgccaggtctgcgattgccgcaaaccacatccggggatgcttttgtcagcacgcgattatttgcatattgatatggccgcttcttatatggtgggcgataaattagaagatatgcaggcagcggttgcggcgaacgtgggaacaaaagtgctggtgcgtacgggtaaacctattacgcctgaagcagaaaacgcggcggattgggtgttaaatagcctggcagacctgccgcaagcgataaaaaagcagcaaaaaccggcacaatgattaaaagatgagcggttgaaataaaaatgcatttttccgcttgtcttcctgagccgactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgagctgaaagccgcgtcgcaactgctctttaacaatttatcagacaatctgtgtgggcactcgaagatacggattcttaacgtcgcaagacgaaaaatgaataccaagtctcaagagtgaacacgtaattcattacaaagtttaattctttgagcatcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcttttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgcagtgctcacacagattgtctgatgaaaatgagcagtaaaacctctacaggcttgtagctcaggtggttagagcgcacccctgataagggtgaggtcggtggttcaagtccactcaggcctaccaaatttgcacggcaaatttgaagaggttttaactacatgttatggggctatagctcagctgggagagcgcctgctttgcacgcaggaggtctgcggttcgatcccgcatagctccaccatctctgtagtggttaaataaaaaatacttcagagtgtacctgcaaaggttcactgcgaagttttgctctttaaaaatctggatcaagctgaaaattgaaacactgaacaatgaaagttgttcgtgagtctctcaaattttcgcaacacgatgatggatcgcaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcatgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgtgaaggtgtactgtgaggtatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcagaacgcagaagcggtctgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccacttattaagaagcctcgagttaacgctcgaggttttttttcgtctgtatatctattattgccagaatcgcaaaaatcctctgcattttacgctctttttcctcaacagtctgaagcccataatcacctcagttaacgaaaatagcattaaaagaggcatattatggctatccctgcatttggtttaggtactttccgtctgaaagacgacgttgttatttcatctgtgataacggcgcttgaacttggttatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccaagtctgaaagagagcctgcaaaaattgcgtaccgattatgttgatctgacgctaatccactggccgtcaccaaacgatgaagtctctgttgaagagtttatgcaggcgctgctggaagccaaaaaacaagggctgacgcgtgagatcggtatttccaacttcacgatcccgttgatggaaaaagcgattgctgctgttggtgctgaaaacatcgctactaaccagattgaactctctccttatctgcaaaaccgtaaagtggttgcctgggctaaacagcacggcatccatattacttcctatatgacgctggcgtatggtaaggccctgaaagatgaggttattgctcgtatcgcagctaaacacaatgcgactccggcacaagtgattctggcgtgggctatgggggaaggttactcagtaattccttcttctactaaacgtaaaaacctggaaagtaatcttaaggcacaaaatttacagcttgatgccgaagataaaaaagcgatcgccgcactggattgcaacgaccgcctggttagcccggaaggtctggctcctgaatgggattaagcctctctgacagctcctccgggagctgtttttacatgctcgctaaggaaatcgataaaagcccggatgcgcgtacttaccgcacggtcgctgtaatagacggcactgaatggcatttccactggcaacactttatctgccattaactccaccaattctccgcgagcgatttctttgtcgatcatgtagtcggacaaacacgcaatcccgttgccactcaggcaaagctgtttcagtgtttccccactattggatgacaaaccgtacttcacctcatgtaattgtccatcgctacgggctatcggccaggtattgagggaagcgggttcagtgaatcccaggcaaatatgttgctttaaatcgtcgatcgtttctggcttcccgtagcgggaaatataatcgggggaggcgataatttttcgataactgttaaataacggcctggcacgtaagctggaatccgttaacgtaccagcgcgtatcgcgacatccacttttctttcgatcaaattaataatcgtttcggaggagactagcgacaaagtgacttccggatagcgttcacggaaaggcttaattaacggcatcagaaagtgcagcaccactggagttgcggcatcgatccgtaacagtccacgcggtgtattacgcgtctccataatttctgattctgccgctgccatctcctgcaaaattgactgtacgcgacgaaaataacgctcgccttcttccgtcaggctaagttgtcgcgtggtccgattaagcaggctaacgccaagtttcatctccagctttttcaccgcccggcttaccgctgagtttgcttgccctaattgttccgctgcccggctaaagctgccgctttcgacgaccgaaacaaaaatggcgagttcttccgacgtggctttcatttttgctcctgttgcaaaatagaagagatattttgaatttatttgtcattaaaccatcaggatgcgtgatatgtcatgcgatttaatgttctccataatgagcaaaattctgaccggtgtaagcacttgcttacataacaatatacaattgctcgttgaaagagtgagctaaaatccctataacagtagaaccctcccgagtgcggaagggttgacgtaatagaggtttcaaagtcaaaagtgcgaaaaaacacctatgccatgcgctatgttgccggacaacctgcggaaaggatcttaccgccggggtcttttgcgagcatcggccaggcattaccacctggggaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgaccgctaactatcttgccgccgatcaggtacccgctttcgtgctgccacaacatccttctggcgtaatgaccctttcggcggcacatccagtgtattgctgcccgttacgtgaacgagaacccattttgcgtctggcgaagtcggcactggtgacggtctatccattacctgacacccgcctgttgatggtggttaatatacacgccgtcaacttcagtctgggcgtggatgtctatagtaagcagttacttcctattggcgatcagatagctcaccacagcggcccggtcattatggcgggagatttcaatgcctggagccgtagaaggatgaacgcgttatatcgctttgcgcgggaaatgtcgctgcgccaggtgcgttttaccgatgatcagcgccgtcgggcgtttggtcgcccgctcgattttgttttctaccgtggtctgaacgtcagtgaagcttctgtactggttacgcgcgcttccgatcacaatccgctactcgttgaattcagtcccggcaagcctgataaataaggtatgtcaggtctgccacagggcagaccaacgtttggcgctgcgcaaaacgtgagcgcggtggtggcgtatgacttatctgcccacatgctggatgtcgtggcacaagctgccgaagcccggcaactgaaaaatatcaccacccgccagggatatgccgaaagtctgccatttgccgataacgcatttgatattgttatcagccgttattctgcccatcactggcatgatgttggtgcagcactgcgagaagtgaataggatattgaaacctggcggtaggctgattgtgatggacgtaatgtctccgggtcacccagtgcgcgacatctggttacagacggtagaagcattacgcgatacctctcacgtacgaaactacgccagcggtgagtggttgacgttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgagaacgtattttgccttgcagaatgatggctttttcaccagtgatatcatcatggtagatgcacataaagcggcataaataaaaaaggcaccgggggaatcggtgcctttttattatctggtttgtcaggaatctggcatgttgttgtttttcacaaacaacgtcagcttatcgcctggttgcagattcgcagtgtcgctgttccagcgcatcacatctttgatgttcacgccgtggcgtttagcaatgcttgaaagcgaatcgcctttgcgcacacgatacgtaatgctatcgctgttgtttgccagtcgctgtgcgctactgcctgcaccaatcgtcaaactttggcctggcttcagcttagatccgcgcagtttgttccactgctgcaaatctttggtgcttacgccgagacgtgaagcgatacttgaaagcgtgtcgccagagcgtacggtgtaaacacggctgttaagcggcgtattgtcggcaaccagcgtcgactgtacagcagcaatttcgcctgaagccagagattcacgcagttgatctgcatgcttctttggcaccatcacgtactgcgggccacttgcgcccagcgtggagccttttacgccagcgttgaatgtcttcagcttgctgacggaaatccccgccatatctgctaccttcgccatttcaaccgggctgctcaggtgcacacgcgccagagcacggctttcatcggtcgttggcagacgtacgccataacgcttgctgtttttgagaatatcactcaatgccagcattttaggcacgtactgcttcgtttcctgcggcaacggtaacgaccagaagtccgtggatttcccacgcgctttgttcgttttaattgccttcatgacccgaccttcgccgctgttataagccgctacggtcagaagccagtcgccgtcaaacattttgttcagacgctgcatcatattcagcgcggcagttgttgaagcaacaacatcgcgacgcgcgtcataattgcgggtctgtttcaaaccataattgcgccccgtgctcggaatgatctgccagatgcctgcggcattggcgccagacgttgcgtgaggatcaaaagcgctctccactatgggtagtagtaccagttccataggcatgttacgttttttaacttgccctgctatccagtacatatacggctctgcccgtaaagttacatcgtggagatagctcttattgcgtaaatatttctgtttctgttcgcgaatccggtcattttccggaattcccatctttagctcgtcgccaatgaaagcccacaagtcaccatctggcgcgatagacgtcccatcgtccatccatcgtgcctgacttgtaaactttgctgcttccccttgaccagctgcagaaaggctctgtgcgtgctgttgaacgttgccggtactctggcaacccacgagcaggacagaggcgagtaatatcgcttttgccttcatgtgtgtgtcaatagttgcttaaaagacgaccgatcataacggcgaacggagccgatgacaagaaagttttatcagaacctatctttctttgaccttaaccatgcaaaacgctcttcaggttgttgcaataatgtttcttcattaattacattaattaaatcaatatcttccgttcttaaaaaaacattaatttgccgctcatttttcagaattacgggtagtgttatttgattttttgcccgtaactccttaactttacgataataatcatttatggacaaatcgtgcggaagaatactcaaagcaaacttcatatttgataaggtatattcatgagcacaacataccaatgtatcgtcaggtaacgcacttaactttttaagtgattgatacatttgtgatgctgtcccttcaaacaaccgaccacacccaccagaaaacagtgtgtcgccgcaaaatagataaggtttactgaagtaacagatatgtcctaaagtgtgacccggcgtagcaattacactaaattcatgccccaaaacgaaggcagtttcgccatctttgactacctgtgttgttcccttatcttgtgtctcttgtggaccatacaccacaatttgtggaaacttttccaccagttcttttacgccgccaacgtgatcgtggtgatggtgggtgagaaatatggcctccggttgccagttattggcggcaatggcgtttaatactggctctgcgtctccgggatcgacaatcaggcagcgacctgcttcatcattcaaaacccagatgtaattgtcatcaaaggcgggaatactgttaagattcatagattacctctcagtgtgaaacggaaggttgtgatgaaaccggcaagagtccctcaaactgtcgtggctcctgattgctggggcgatttgccctggggaaagctttatcgcaaggcgctggagcgccagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtacaggcggacccacttcatcttccttttgccgataaatccgttgatgtttgtctactggcacatacattgccgtggtgcaccgatccgcatcgtttattgcgtgaagccgatcgggtattgattgatgatggctggctggtcattagtggcttcaatcccatcagttttatgggattacgcaaacttgtgccggtattgcgcaaaacctcgccctataacagccggatgtttactctgatgcggcagctggactggctctctttgttgaattttgaagtgctacacgccagccgtttccacgttctcccgtggaacaaacacggaggaaaactattgaatgcgcatattcctgcgcttggttgcttacaacttattgttgcccggaaacggactattcctttaacgctaaatccgatgaaacagagtaaaaacaagccacgaattcgccaggcggttggagccacccggcaatgtcgtaaaccacaggcttaaacttcaacttggtagcctgtatcttccagtgtgggattcatcgccgcggcacgagccagttcatcacagcgttcgttttccgggtgtccggcatggcctttaacccattcccatttgatttgatgctgccccaatgcagcatcaagacgttgccagagatcgacattttttactggttttttgtctgcggttttccagccacgttttttccagttatggatccactgggtgataccctggcggacatactggctgtcggtactcaaaatgacttcgcaatgttcttttaacgcctccagcgcgacaatagcggccatcaactccatacggttgttggtggtgcgggtgtagccagcgctaaaggttttctcgcgtccgcgatagcgtaaaatagcgccgtaacccccaggtcctggattgcccagacacgaaccatcggtgaaaatttctacctgtttaagcatctctggtagacttcctgtaattgaatcgaactgtaaaacgacaagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaatacctgtgaaaggcgctaaaaatagcgacttgggcgatttttgcagcaaacgattcaaaagatgagaaaaaccgttgacgaaggtcgaggcaatccgtaatattcgcctcgttcccaacggaacacaacgcggagcggtagttcagtcggttagaatacctgcctgtcacgcagggggtcgcgggttcgagtcccgtccgttccgccactattcactcatgaaaatgagttcagagagccgcaagatttttaattttgcggtttttttgtatttgaattccaccatttctctgttcaatgattttactctggcgtaggtgcgtgattctcgcttgttgtctcattcattaaaattcaataatgatatcgaaccattcagcttaaatatatttctagagaataaatttatattgattaaatgaatgtatatttcaaattgattttgtttgttattatttaagtgaggtatataattagagtccgttatcaatgctaaatattctaatcattatgacaggcgagggagtgtccaattatgaattcaaaaaagctttgttgcatatgtgtgttattctcgctgcttgcaggatgtgcctctgaatcttctattgatgaaaagaagaaaaaagctcaagtcacacaaagtaatattaataaaaacactccccagcaactgacagacaaagatttattcggtaatgaaaccactctggccgtatccgaagaggatattcaagctgcgcttgatggagatgagttccgcgttccccttaattctcctgtaatacttgttcaatccggcaaccgcgcaccggaaaccattatgcaggaggagatgcgaaaatattatactgtttccacattctctggtatcccggacaggcaaaagcctctgacttgtaacaaaaacaaagataaaaatgagaacgaggatgttgccagtgctgagaatatgaactggatgcaggcactgcgttttgtggctgcaaaaggacatcagaaagcgattattgtttaccaggatatgttgcagacaggaaaatatgactctgcgctgaaatcaacagtatggtccgactataaaaatgacaaactcactgacgctatctccctgcgctacctggtacgtttcacgctggtggatgtggcaacaggtgagtgggctacctggtcgccggtgaattatgaatataaagtgcttccaccattgcccgacaagaatgaagccagtacgactgatatgacagagcagcaaatcatgcaacttaagcaaaagacctataaagcgatggtaaaagatttggttaaccgctatcaataataaattatatctgccgccaggaatttctggcggcaataatacaaaattctttgcataagaaatttttcttgacaaagacagtgcaagaaaggacatggaatccggagttaaaaactgtttgttttagaatatttaattatttaactgctgaatcttccttgcgagaaatatatccattattacatttcatgccatttttaatatagattgctcctgggaaaattcccgtattattaccgcaggggtgataattagtattgacatatcctgtgacaaaaggagctattaaaggtgctattacgatagctattagtaaaaatataagagttagctgtattgttatgtctgtggcgaaattgactaccttcgtttttttgattaagaatgattttattatcgtaagtaaaattacatgaatatttaaaaaggaaaacgacatgaaaccgaagcacagaatcaacattctccaatcataaaatatttccgtggagcattttattattgaatatagaggtttaactccggtaaaaaacaaagaagcattgaatgcagggaaaaataatatggccataaaaaacatcgaaagaaactcttttaatttaacatgtaaacgcatggttaatcctcatatcacgggtggagtgttaagaacatacataaatggagtcatgttttcccttttccatttatcaagttcctgttgccgttttagtccatctctaattgcatattttaatttttctgataaatggcattgagcatcgatttcatttaaaacaactgtacacactatccctgtcagtaaaattgctcctccgacaagaattactggaaagccaaagctaacacaggcaaaagaagccagacttccaatagcggttgcaacaccaccggctataactgctttggccacatccattgaaaaatcgccaagaaaattaaccagatctcgctctgaactcataataaattctatggttctgctgatttaaccgcagagaagttcgccacagcaatccgaaaccactggcacgtggagaataagctgcacaggcgtctggacgtggtaatgaatgaagacgactacaaaataagaagaggaaacgcagcagaattattttcagggatacggcacattgctattaatattttgacgaatgagaaggtattcaaggcagggttaagacgtaagatgcgaaaagcagccatggacagaaactacctggcgtcagtccttgcggggagcgggctttcgtagtaataccccgactctccccgtccttaaacacaacccccactcaccacaacctaaactcatccgcatcctgccatgccggaaacttttctctatattcccgcaatgctgccatcgacagctccgcatcaatgcgcgttgcctgatgcgcgtcggcagtagcgataatctctccttgcggattaatcacccggctgtcaccgcgataatggcagccgttgccatcgctgccgacgcgattgcatcccgccacatacgcctgattctcaatcgcgcgggccgtcagcaatgcctgccagtgcagagagcgcggagcaggccagttggcgacgtacagggcgaggtcataatcgttgagattgcgcgaccacacaggaaaacgtaagtcgtagcacaccagcggcaaaatacgccagccgcgccattccacaatcactcgcgcattgcccgctttataatgtagatgctcatctgccatgcggaacagatgacgcttatcataaaaatgtaccgtgccgcccggctcaaccagcaaaaagcggttaaccgaaccagactccgtttgtaatgcaacactgcctgcaatcagcgcattgcactgctgcgccttagctgtcatccagttcactacgtcatcttgtgctagcgacgaagctgccgcttccatggcaaagccgctggtaaacatctccggtagaacgatcacatcgcgcccggtaataccttccagttgacgatcaaaatgacgcaggttggcaggaccatccatccacaccagtggttgctgcaaaagcgtaatcttcaaaccaggcacggtgtacaactcctttatgcgaagggttttataactttaacaccttatcaggcagttgccttagcgcagaataaattgataacaaatgctgatattggaaatatctgatttgcaaattatcgtgttatcgccaggctttaggaggttaataacatgggcaggataagctcgggaggaatgatgtttaaggcaataacgacagtcgccgctctggtcatcgccaccagtgcaatggcgcaggatgatttaaccattagcagccttgcaaagggcgaaaccaccaaagctgcatttaatcagatggtacaagggcataagctgcctgcctgggtgatgaaaggcggtacttatactcccgcacaaaccgtaacgttgggagatgagacgtatcaggtgatgagcgcgtgcaaaccgcatgactgtggctcgcaacgtatcgctgtgatgtggtccgagaaatctaatcagatgacggggctgttctcgactattgatgagaaaacgtcgcaagagaaactcacctggctgaatgtgaacgatgcgctttcgattgatggtaaaacggtgttgttcgcggcgttgaccggcagcctggaaaaccatccggatggctttaattttaaataattagcggataaagaaacggagcctttcggctccgttattcatttacgcggcttcaactttccgcactttctccggcaactttaccggcttcgtcgccagctcttccggatcaaagtcatcaacgttaatactgcgcagacggctttcttcagctttcaccagaatagcggcttcatctttatcaatcagccccttcaccagcgcgttgtgcgccagttcatccagacgggtaaacggcaggtttttacccagctctttacagatccgctgatgaattgggtcggcggcaatcacatccaccagcgcctcttccagcaagccaaccggattatgctcgctcggcgtcaggtactgaccgcgaccaatgcgggaacgggtggcgttcggcacttgtaaaatcttcgccactttatgatccagcttgtcagaaggtgccagataatgacgtccggtcgggaagatcaccacattcagcagcccggcaaccacgcggttcgggaagttttgcagtaaatcatccatcgcctgttcagcctgatacagcgcatcttgtacgccccagtgcaccagcggcaggtcggcttcattacggccttcgtcgtcataacgcttcagcacggcagaggcgaggtagagctggcttaaaatatcccccagacgggccgagatgcgctcgcgacgtttcaggctgccgcccagcactgccatcgagacatcagaaagcagggcgaggttggcgctcaggcggttcaggtgctgatagtagcgtttagtggcatcgccggttggcgtgctgctggttaaaccgcgcgtcaggcccagccagaagctgcgaactttgttgctaccgacgtgaccgatatgtttgaacaacagtttatcgaacgcgttgacgtcattgttcttcgccgcttccatctcttccagcacgtacggatggcaacgaatcgctccttgtccgaagatcatcatgctgcgggtcagaatgttagccccttcaacggtgatggcaatcggtgcgccctggtaagcacgcgccaggaagttgctttgcccgagcataatgcctttaccgccggtaatatccatcgcatcaataatcgactgctgcccgcggtgggtacagtgatacttaacgatagccgacagcacggcaggtttttcgccgagcataatgccgtaggtaatcagcgatgccgcagcatccatcacgtaggcattaccggcaatacgcgccagcggctcttcaatcccttccatcttaccaatagagattttgaactgacggcgaatgtgagcatacgcgccggttgccagcgctaccgatttcacgccgccggttgagttggaaggcagggtgatgccgcggcctaccgagaggcactccaccagcatccgccagccttgcccggccattttcggcccgccgatgatgtaatcgatcggcacgaagacatctttaccgcgcgtcggtccgttctggaacggtacgttcagcgggaagtggcgacgaccaatttccacgcccggcgtggtggttgggatcagcgcacaggtaatgcctaaatcttctgcaccgccgagtaatttttccgggtcggagagtttaaacgccagcccaagcacggtcgcaatcggtgccagcgtaatgtagcgtttgttccaggtcagacgcatccccagcacctgctggccctgccattcgcccatgcagacaatcccggtgtccggaatcgcgcccgcatcggaacccgcttccgggctggtcagtgcaaagcaggggatctcctgaccacgcgccagacgcggcagatagtgatctttctgctcgtcagtgccgtaatgttgcaacagttcgcccgggcctaatgagtttggcacgccgacggtaatcgccaggatcccgctcacgccggagagtttttgcagcacgcgagactgggcataagccgagaactccagcccgccgtactcttttttgatgatcatcgcgaagaaacgatgctctttaaggtacgcccacaactccggcggcagatccgccagctcatgggtgatctggaaatcattcgccatccggcaggcttcttctaccgggccgtcgagaaacgcttgctcttcggcggtcaggcgcggctgcggatagttatgcagctttttccagtccggcttgccctggaacaagtcgccctcccaccaggtggtgcccgcatcaatcgcttctttctcagtgcgcgacatcggcggcatcaccttacggaaaccgcgaaataccggcgcggaaatcatcgacttacgcataggcgcaaagttaaatggcacgaggataatggccagaggcaccagtacccacgccgaccacagaccagcaacgccgagggcggctgtccaggcgagcaaaatcagactgctgataaataagctcacgcggtgatagaacaacgcgccgagcaggacaaccgtagcgagaatactcaaaatcatcataacgaaaagccccttacttgtaggaggtctgaccacttgtgatgatatggttgtagtggatgtaaaaacatttagcaatatgtttacaatataattacaacaaagctcacattgttgctgtttttatccgcacttcaggtcaaaaagtcctggtcatagcacctgcccgtacttctcgcttttggcggtatccggtacactgcattttgtctattacatttatgctgaaggatatcctcatgtaccaggatcttattcgtaacgaactgaacgaagcggcggaaacgctggctaactttttaaaagatgacgccaatattcacgccattcagcgcgcggcggtcctgttagcagacagctttaaagccggtggcaaagtgctttcctgcggcaacggcggttcccattgcgacgctatgcactttgccgaagagttgaccggtcgctaccgtgaaaaccgtccgggctacccggcgattgctatttctgacgttagtcatatttcctgcgtcggtaatgatttcggtttcaatgatattttctcccgctacgttgaagcggtaggtcgcgaaggcgatgtactgctggggatctccacctccggtaactctgcaaacgtgatcaaagcgatcgcagcggcgcgtgagaagggaatgaaagtgatcaccctgaccggtaaagacggcggcaaaatggctggcacggcggatatcgaaattcgcgtaccgcactttggttatgccgaccgcattcaggagattcacattaaagtgatccatatcctgatccagttgattgaaaaagagatggttaagtaagtctggcgtaggccggataagacgtttacgccgcatccggcatttgtgcgctgatgcctgatgcgacgctgacgcgtcttatcatgcctacaaatctgtacgcgaaccgtaggccgaataatgcgttcacgccgcatccgacctgaaaattcttaaatcaatcttcgccgggggccatgcgctcccgctgttgtggaggttacccatgtgcgaattgctcgggatgagcgccaacgtccctaccgatatctgctttagtttcaccgggcttgtacagcgtggtggtggaaccgggccacataaagatggctggggcattaccttttacgaaggtaaaggctgtcgcacatttaaagatccacaacccagctttaattcccccatcgccaaacttgtccaggactacccgataaaatcctgttcggtggtggctcatattcgccaggctaatcggggcgaggtggcgctggaaaatactcacccatttacccgcgagttatgggggcgtaactggacttatgcccataacggacaactgacgggctacaaatcactggaaaccggcaacttccgcccggtaggcgaaaccgacagcgaaaaagccttctgctggctcctgcataaattaacgcagcgttacccgcgcacaccgggcaacatggcggcggtatttaaatatatcgcctcactggcggatgaactgcggcagaagggcgttttcaacatgctgctttcggacgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcaacacagccgctgacgggcaatgaaacctggcaaaagattatgccaggcgaatggcgcttattttgcctcggggagcgtgtagtttgatgccagttgtggctgcacaacttcgtggcttaacggcttgctgaccacgtaacgaccattgaccacagaaacggttggtggcttacgggtttgctcaaagtagtcgtaacccggcttcagttgctcccagaagtccttaaagttggaatatttatggcgcttcatattggcgtcggtcatgcggaacgggtaaatactcacttgcacgctcggctgaccaaacaccagcgcaccagtaacgaactggaatatctcatcaataccctgattggtcattgcgtagcagccgatggaaacacaatcgccgtggatcatcaggtatttcccttcataaccatgcgcacggtcataggcattggggaaaccaatattaatcgctttgtagtaacggctgtctggttttaactgattacgctggacgctataaaacccttccgggcttttgaaatcgccctgacgctgttttggccctaagccgccggaatatttacagattttatagctgtcgagcagttgatattgctcgcccattttgacgtagagatcgagcgtacgttcttccttgaagatctggatgtagacaggggatcccatcaactgctgcttatactctttgctcacaggcgtggtagagctactgctgcccagcaaaccggcaaatgaaacgcacgggatcaacaacatcgcaagaattaatgcgattttacgcatactgcttattccttgataaaacggttacacacgccaggacggcaaaatggatcccaaatcggaatagtctggatttggaaggctcacattatcaccaaaagagttttacgcaagcctgtcggcgcagggtttacaaatttcatcggaagcgggctttacccaaagagcgccgcgtgagttccagttctctcaaatcgtaaaagtttatcggtaagtttgtaaatcaggatccagtccggttcgacatgagcatcgcgataacctttccatgaaccttgcagcgggtggtctttataaacagctggaagcggtaaagtattattgataagaagcgtcataagatatttcaatttattcatatccttatgacgcttttgtgcaagttttacatcctttgaatattgtcccgagtattcaatatccctttgaatcatatttaaattcctaatttatcaaataaatcatcggcgtctttggccttatgaacatcaatgccagcttcgctgtttttgattgattgaatggttaattgattaggctcgcgtaaatcaaacggcaatgccttttcacgcgcgacctttgtgagggttatgcgaaccaggtcagagatggtcagccccatcccggccagtacgtccgctgcctgattcttcagatcttcatcgattcgggcgcgaacaaacgcgttagcagccattggggtatctcctgtgctgtatatttattcagcttgaattgtagctcaaatgagcaacagcgacaatccatgagtaatttaataaacggatgtttttacataattaactgaaatatatatgttaattttataataatggtttattaagtttgttcagaaacgatccgggatacactgcaacattaaagcatgaccagccattattgagtatgtccttgccgtcgattccatcctttgtattgtcgggattactgttgatttgtttgccgttttcttcatttgccagcgccaccacatcacatatctctttcagctacgccgcccgccagcggatgcaaaaccgtgcgcgtttattaaaacagtaccaaactcatctgaaaaagcaggccagctatattgtggaaggcaatgccgaaagcaaaagggcgctacgccagcacaaccgggagcagataaaacagcatccagaatggtttcctgctccgctcaaggcgagtgacagacgctggcaggcgctggcggaaaacaaccactttttaagcagcgaccatctgcataacattaccgaagtggcgattcaccgcctggagcagcagcttggcaagccttacgtctggggcggtacgcggcctgataaaggctttgactgtagcgggttggttttttatgcctacaacaagatccttgaggctaagctcccgcgcacggccaatgagatgtaccactatcgccgggcaacgattgtggcgaacaacgacctgcgccggggagatttgctgtttttccatatccacagccgcgagatagccgatcatatgggcgtgtatttgggcgatgggcaatttatcgagtcgccacgtaccggcgaaaccattcggataagccgattagccgaacctttctggcaggaccattttttgggcgcgcgcaggattttgacggaagagacgattttgtaggacggataaggcgtttacgccgcatccggcagttgtacgcaggtgcctgatgcgacgctggcgcgtcttatcatgcctacgagcccgcgaatatttgcgagccgctttcccgatataaaacaacctcattgccaacctttccttttcttcttaccgttgagaaaaaggagtcgccatgtctgaatatcgtcgttattacatcaaggggggaacatggtttttcacggtgaatttacgaaatcgtcgaagccaacttttgaccacccagtaccagatgctccgtcacgccattattaaagttaagcgagacaggccttttgaaatcaacgcctgggtcgttttgccagagcatatgcactgtatctggacattacctgaaggcgatgatgatttttcctcgcgctggcgggaaattaaaaagcaatttacccatgcttgtggattgaaaaatatctggcaaccacgtttttgggagcacgccatccgcaataccaaagattataggcatcatgttgattatatttatataaatccagtaaagcatggttgggtaaagcaagtgagtgattggccattctcaacgttccatcgcgatgtcgcgcgagggttatatcccatcgattgggcgggggacgtaacggattttagtgccggggagcgtatcatttcataattgtgcgcagatgcctgatgcgacgctagcgcgtcttatcatgcctacaaacttgtgccggatcggtaggccggataaggcgtttatgccgcatccggcagttatgcgcagatgcctgatgcgacgctggcgcgtcttatcatgcctacaaacttgtgcctgaacggtaggacggataaggcgttcacgccgcatccggcagttgtgcaccaatgctggatacttacatcaacgcccccataatcttcaactccagctcatccggcacttcgttatacgacagcacatgcagccccggcgcaaacaaccttgcataacgcgccagcaaagggcgcagctgcggtggcaccagcagcaccgggtctttccccgccgctttcatctgctctttcacctgtggcatcgtactctggaactggttgagcatattcggatcgaccggcacgctgtcgagcatcactttcccgccctgttgcgcctgattcaccacgttggtcagcagattttccagctcattattcagcgtatacaccgtcagctcctgcttgcgaacgaacggatgggtaatgctgcgccgcaatgccaggcgcacatcggccgccagcagaatatgatctttcgtcaccgtgctactggcgaccagcacggtggcgatggtgacgatatcgcgcagggaaacgccttcggtcagcagcgcccggtacactttcagcaactggctgtaattgagcgccgcgctcaaatcttccgccagacgcggtgccgtcgacgataaacggttatgcaactgcgtaatatcatcatagttaaacaaatcaggaatatagctgcgcacaatcttatttacatgggtagcgatcacgctggcgctgtcgatcacctgataccccatattcagcgccttcgctttctgcgccgcctggatccaggtgaccggcatcccgtacgccgggtcgttcccctgcacgccgtcaatctcgccgtaggtttcgctggagggcagggccatcagtttatccgccggaatatccgcttcatcagcctttatgccgttgatgaaaatggcgtactgactgggcttaaggcggaagttttcccgaatgcggatctccggcagcagcacgccgttgccgtcagaaatcacctgccgcacgccgcgaatccgctgggtgagcgggttaccctgtgctttgtccaccagcgccaccagtttgtaaccgaggcttaaactgataggctcgatcagcggaatggtttcccaactgacctgctgctcgctggtttcggtgatggtgcgggtcagcgtttcgaggcttttctcttccgcctccgccgccagcggctgtttgctcatccgccagccggtaaaaccaagcagggcgctgaacagcaaaaacggcaggtgcggcattcccggtaccaccgccagcacgaacataatcccggtggcggtgtagagcaccgacgggcttgccagcagctggttacgcacgtcatgggcgatatcgccgttgtcgctgacgcgggtgacgataatcgccgccgcggtggagagcagcagggaagggatctgcgccaccaggccgtcgccgatggtcatcagcacatactgctggaaggcagcatcggcgctcaggttgtatttgaagatcccgatacagacgccgccgatcaggttgatcgccagaatcatcatcccggcgatggcgtccccgcgcacaaacttcgatgccccgtccatcgcgccgtagaaatcggcctcgctggcaacatctttacgccgggtttgcgcctgcgcctggttgatcaatccggcgttaagatcggcgtcaatcgccatctgtttgccgggcatcgcgtctaaggtaaagcgggcagaaacctcggaaatacgctcggcccctttggtgacgacaataaagttgattgtcaacagcgtcagtaaatccgagcgtgaaagcattatcgccgcgctgcacgggcagtcgatttttaacggtggtgggctgtcgccgttaaataaaatcagcccgtctcatccgccaaaacctgccaccgtggcggtgccggaagagacggagaaaaaagcgcgtgatgtgaatgagaaaacggcgctgctgaagaagaaatccgccaccgagcttggtgagctggcaaccagtatcaacaccattgcccgtgatgcgcatatggaagcgaatctggagatggagattgttccccagggattacgcgtgctgattaaagacgaccagaaccgcaatatgtttgaacgcggcagcgcgaagattatgccgttctttaaaacgctgctggtggagctcgcgccagtgttcgactcgctcgataataaaattattattaccgggcataccgatgcgatggcctacaaaaacaatatctacaacaactggaacctttcgggtgaccgcgcgctttcggctcgtcgggtgctggaagaggccggaatgccggaagataaagtgatgcaggtaagcgcaatggcggaccagatgctgctggattccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgaacgcgttaaatgctgaatctttacgcatttctcaaaccctgaaatcactgtatactttaccagtgttgagaggtgagcaatgcgtaaaatcattcatgtggatatggactgctttttcgccgcagtggagatgcgcgacaatcccgccctgcgcgatatccctattgctattggcggcagccgcgaacgtcggggggtgatcagcaccgccaattatcccgcgcgtaaatttggcgtacgtagcgctatgccgacagggatggcgctcaaattatgcccacatctcaccttgcttccggggcgctttgacgcctacaaagaagcctcaaatcatatccgtgaaatcttctcgcgctacacctcgcgcattgaaccgttgtcactggatgaggcttatctcgatgtcaccgatagcgtccattgccacggttctgcgaccctcatcgcccaggaaatccgccagacaatcttcaacgagctgcaactgacggcgtctgcgggcgtggcaccagtaaagtttctcgccaaaatcgcctccgacatgaataaacccaacggccagtttgtgattacgccggcagaagttccggcatttttacaaaccttaccgctggcaaaaatccccggcgtcggcaaagtctcagcggcaaaactggaagcgatggggctgcggacctgcggtgatgtacaaaagtgtgatctggtgatgctgcttaaacgctttggcaaatttggccgcattttgtgggagcgtagtcaggggattgacgaacgcgatgttaacagcgaacggttgcgaaaatccgtcggcgtggaacgcacgatggcggaagatattcatcactggtctgaatgtgaagcgattatcgagcggctgtatccggaacttgaacgccgtctggcaaaggtaaaacctgatttactgattgctcgccagggggtgaaattaaagttcgacgattttcagcaaaccacccaggagcacgtctggccgcggctgaataaagctgatctaatcgccaccgcgcgtaaaacctgggatgaacgccgcggcgggcgcggtgtgcgtctggtggggctgcatgtgacgttgcttgacccgcaaatggaaagacaactggtgctgggattatgatgtatactattatgtatattctggtgtgcattattatgagggtatcactgtatgcatcgaattctcgctgaaaaatcggtcaatatcactgagttacgtaaaaacccagctaaatactttattgatcaaccggttgcggttctttctaataatcgccccgcaggatatctcttaagtgccagcgcattcgaagcgttaatggacatgcttgctgaacaagaggagaaaaagcccataaaggcgcgcttccgtccaagtgctgcaagattagaggaaattacacgccgcgctgaacaatatcttaatgatatgacggatgatgatttcaatgactttaaggaataaggatgcgggtattcaaaacaaaacttattcgcctgcaacttacagcagaggaacttgatgcgttaacggcggattttatttcctataagcgtgacggtgttttgccagatatatttggtcgcgatgcactctacgacgactcctttacctggccattaatcaaatttgagcgagttgctcatattcatctggcaaatgagaataatccatttccgccacagttgcgccaattcagcagaacgaatgacgaagcgcatttggtatattgtcagggggcgtttgatgagcaagcatggttgctcattgccattctgaaacctgaacctcataaactggctcgagataacaaccaaatgcataaaattgggaaaatggcagaagcgtttcgcatgcgtttttgaatttatattatgaataacatacaaataagaaactatcagcctggcgattttcagcaactatgcgctattttcattagagcggttacgatgaccgccagtcagcattattcaccacaacaaatttccgcctgggcgcagattgacgaatctcgctggaaggagaaactcgcgaaatcacaagtgtgggttgcgatcattaatgcacaaccggttggttttatttcccgcattgaacattatatcgatatgttatttgttgaccctgaatacacccgccgtggggttgccagcgctttgttaaaacctttgattaagtctgaatccgaacttacggtggacgcaagcataaccgcaaaacccttttttgaacgttatggttttcagacagttaagcagcagcgcgttgaatgccggggagcgtggtttactaatttttatatgcgatataaaccgcaacattaaatccagcttgcaatgaaaataacgcccgcctggtatgtgcgcgttttctgattccacaaactgcaaggaggtaaatcatgacaaatcctttatcaatgactctttgcagacctttccaggattaattctttttttcttgccctggattcgtctgccatttcctgatttttatatttatatactctaaataattcgagttgcaggaaggcgacaagcgagtgaatcgccaggagcttacataagtaagtgactggggtgaacgaacgcagtcgcagtacatgcaacttgaagtatgacgagtataaatggaatggtacatgggcaaatatattcgtcccttatccgatgcggtatttaccatcgcatctgatgacctgtggatcgagagtttagcgatccaacaattacacaccacggcaaatttacccaacatgcagcgcgtagtggggatgccagatttacaccccggacgcggctacccgattggcgcagcgttcttctctgttggtcgtttttacccggcaagacgtcgcggtaacggtgctggaaacagaaacgggccgctactctgacacactgcgttcggcgctggtttctctcgatggcgataacgcatgggcattaagcgaaagctggtgtggcactattcagtggatttgtccgagtccgtatcggcctcatcatgggcgcaaaaactggtttctgggcattgggcgttttaccgctgatgagcaggaacaatcggatgcaatccgttatgagacgctgcgttcgtcggggccgggcggtcaacatgtcaataaaaccgactcggcggtacgcgccacgcatttggcatccggtattagcgtgaaggttcagtcagagcgtagtcagcatgctaacaagcggctggcacgattgctgattgcctggaagctggagcaacagcaacaggaaaatagcgcggcgctgaaatcgcagcggcgaatgttccatcaccagattgaacgtggcaacccgcgacggacatttacagggatggcttttatcgaaggataatgaaggatgaaactgccggaaggcgattaaacgccatccggcagcaaatcaaataattacttcgccggaatttctttcagcagttcagtcagcagtgtccagtaatgacctacgctttcgatgtgaacttgctcatccggagagtgtggaccggtgatagttggcccgatagaaaccatgtccatttccggatacggttttttgaacagaccacattccaggcccgcgtggataatctggatgttcggcgtcttgttgaacaggcgctgataggtttcacgtaccagatgcatcaccggagaattagcgtccggctgccagccaggatatgcgcctttcgcttcggttttcgcgccagccagtttacccagcgaatccagcatgctcaccacgtagtctttaccgctgtcgatcagtgaacggatcaggcagtgaatttctacgttattgtcagtcatggtcaccacaccgacgttcagggaggtttcaaccacacctttggctacatcggagttacgaatcacaccgttcggggtggcgttcagcagacgaataaaggtatcgcgagatttcgcaatcagggcagctttatcgttcgctacagagtccagcaacaaggccagatttttctctttttctgccagctcgtttttcaggatctcctgataggtattcaccagagatttcaggacgtcgactttatcagctgcgacagcaatggtcgcaaaggcttcacgcgggatggcgttacgcagtgtgccgccgttgaaatcgataaggcgcagatccagttcttccgcatgacccgccaggaagcgcaccagcagtttgttggcattacccagcccaacgtggatttccccgccggagtgaccgcctttcagaccttttaaggttaacttgaaggtttcaaaaccagctggaaccgcttcacgatctaaatgcaggttggaggtgaagtcgataccccccgcacaacccatgtagatttcaccttcttcttcggagtcggtgttaatcagaatatcagcctgcaaccagttgccctgtaagccgaacgcaccgtccataccggcttcttcggtcatggtcagcagcacttccagcgggccgtgaaccacgttttcgtcagccagaaccgccagcgcagaggccataccaatgccgttatccgcacccagcgtggtgccgcgcgctttaacccattcgccatcaatataaggctggataggatctttcgtgaagtcatgcacggtgtcgttatttttctgcggcaccatatcgaggtgggcctgtaagacgaccggtttacgattttccatacctgcggtagcaggtttacgaatcaggatattacctacctgatcgcgttcgacatggaaacctttctcttttgcccaaccaacaatgtattcagcgagttgctcttcatgataggacgggtgaggaatagaacagattttggcaaaaatatcccacagcggctgtggagataattgagacagttcagacacgttaagtctccttgtcgatcacccgcaaaacagtattgcaggtcacagggttagcagaaaatgttgtcaacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccacccaggcgatggtgtggcaacaaaaagcctgtgcggaagacgatccgcaactcagtggtcgtcactggctgcatgcggctacgttgtacaacattgccgcctatcctcatctgaaaggagatgacctggccgagcaagcgcaggctttgtcaaaccgcgcctatgaagaggccgctcagcgtctaccgggcacgatgcggcagatggagtttaccgtacccggcggtgcgcccatcaccggctttttgcatatgccgaaaggcgatggcccgttcccgacggtattaatgtgtggtggtctggatgcgatgcagacggactattacagcctgtatgaacgttattttgcgccgcgcggcattgcgatgctgactattgatatgccgtcggtgggcttttcttcaaaatggaagctcacccaggactccagcctgttgcatcagcacgtcttaaaggcgctgcctaacgtaccgtgggtggatcacactcgcgtcgcggcctttggtttccgtttcggcgctaacgttgccgtgcgtctggcataccttgaatcgccgcgtctgaaagcggttgcctgtcttggtccggtagttcataccctgttgagtgattttaagtgccagcaacaggtgccggaaatgtatcttgacgttctggccagtcgtttggggatgcatgatgcttccgatgaagcgttgcgcgtggagctgaatcgctattcattaaaagtgcaaggattgctgggacgtcgctgcccaacgccaatgttatcaggctactggaagaacgatccgttcagcccggaagaggactcacgcttaatcacctcatcatctgctgacggtaaattattagagatcccatttaacccggtgtatcggaattttgacaaaggtcttcaggaaatcaccgactggatcgaaaaacgcttgtgttaaaaatttgctaaattttgccaatttggtaaaacagttgcatcacaacaggagatagcaatgacgttaccgagtggacacccgaagagcagattgatcaaaaaatttaccgcactaggcccgtatattcgtgaaggtaagtgcaaagataatcgattctttttcgattgtctggctgtatgcgtcaacgtgaaaccggcaccggaagtgcgtgaattctggggctggtggatggagctggaagcgcaggaatcccgttttacctacagttaccagtttggtctgttcgataaagcaggcgactggaagagtgttccggtaaaagacactgaagtggttgaacgactggagcacaccctgcgtgagtttcacgagaagctgcgtgaactgctgacgacgctgaatctgaagctggaaccggcggatgattttcgtgacgagccggtgaagttaacggcgtgagtgaaatgtgccggatgcatcacatccggcaatattcattaaaactgatacgtcatgccaaccgcgacaatatcatcattattaatattcaatttgttatcgctatccagttggttgattttataatcaacaaacgctgacatatttttgttgaaataatacgtagcaccgacgtcgatataattgaccagatcttcatcaccgataccttcaatatctttccctttcgataagacataacccagcgatggacgcagaccaaagtcaaactggtattgagcgaccgcttcaaagttctgtgtcttattggcaaagccgccagttattggcgtcattttgcgtgtttcagaatagaaagttgccagataaatattattggcatcgtatttcagacctgttgcccatgcttctgcacgcttgcctgtgccacggctttgcaggttctgctcgttggtgcgatctgagttggtataggccccactaatggcgaaatcgctgccgccaaagtcatatgtcaatgacgtgccgaagccatcgccgttttgctttttaacgtcgcggttttcgtttttcccttgatattgcagggttaagttcaggccatcgataacgccgaagaagtcggtgttccgatacgtcgccagaccgctggcgcgtttggtcataaagttgtcggtctgcgccgaggaatcgccaccaaattccgggaacatatcggtccaggcttccacgtcatacaacgcccccaggttacgaccataatcgaaagaacccaaatctttatatttcaacccggcaaaagcgagacgcgttttttgctgtgcagtatcactctctgctttattaccggcaaactctgcttcccaacgaccataaccagtcagttgatcgttaatttgtgtttcgcctttgaaaccaaaacggatataactctggtcgccatctttactggcgttatcactcatataatgcatggctttaactttgccatagacatccagtttattaccgtctttattatatatttctgcagcctgtacagatgcagatgccacaatgcccatcaccactaatgccagagtgctctttttcattttcattcctgattttaattaacgcgcgaatattcagcgggagagtcccgttgaaaacaggaaagtttttaacctgagattgttaaagatatattacagattaataatattcttaaaatgtggtaatttattaaatctgtaataaaagcgtaaacaactgccgctaggcttgctgatcccgcgcaacaaaacgccatgctttgctcgcagatggttggcaaccgacgacagtcctgctaaaacgttcgtttgatatcatttttcctaaaattgaatggcagagaatcatgagtgacagccagacgctggtggtaaaactcggcaccagtgtgctaacaggcggatcgcgccgtctgaaccgtgcccatatcgttgaacttgttcgccagtgcgcgcagttacatgccgccgggcatcggattgttattgtgacgtcgggcgcgatcgccgccggacgtgagcacctgggttacccggaactgccagcgaccatcgcctcgaaacaactgctggcggcggtagggcagagtcgactgattcaactgtgggaacagctgttttcgatttatggcattcacgtcgggcaaatgctgctgacccgtgctgatatggaagaccgtgaacgcttcctgaacgcccgcgacaccctgcgagcgttgctcgataacaatatcgttccggtaatcaatgagaacgatgctgtcgctacggcagagattaaggtcggcgataacgataacctttctgcgctggcggcgattcttgcgggtgccgataaactgttgctgctgaccgatcaaaaaggtttgtataccgctgacccgcgcagcaatccgcaggcagaactgattaaagatgtttacggcattgatgacgcactgcgcgcgattgccggtgacagcgtttcaggcctcggaactggcggcatgagtaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgccggcgggtgaaatcacggtagatgaaggggcaactgccgccattctggaacgcggcagctccctgttgccgaaaggcattaaaagcgtgactggcaatttctcgcgtggtgaagtcatccgcatttgcaacctcgaaggccgcgatatcgcccacggcgtcagtcgttacaacagcgatgcattacgccgtattgccggacaccactcgcaagaaattgatgcaatactgggatatgaatacggcccggttgccgttcaccgtgatgacatgattacccgttaaggagcaggctgatgctggaacaaatgggcattgccgcgaagcaagcctcgtataaattagcgcaactctccagccgcgaaaaaaatcgcgtgctggaaaaaatcgccgatgaactggaagcacaaagcgaaatcatcctcaacgctaacgcccaggatgttgctgacgcgcgagccaatggccttagcgaagcgatgcttgaccgtctggcactgacgcccgcacggctgaaaggcattgccgacgatgtacgtcaggtgtgcaacctcgccgatccggtggggcaggtaatcgatggcggcgtactggacagcggcctgcgtcttgagcgtcgtcgcgtaccgctgggggttattggcgtgatttatgaagcgcgcccgaacgtgacggttgatgtcgcttcgctgtgcctgaaaaccggtaatgcggtgatcctgcgcggtggcaaagaaacgtgtcgcactaacgctgcaacggtggcggtgattcaggacgccctgaaatcctgcggcttaccggcgggtgccgtgcaggcgattgataatcctgaccgtgcgctggtcagtgaaatgctgcgtatggataaatacatcgacatgctgatcccgcgtggtggcgctggtttgcataaactgtgccgtgaacagtcgacaatcccggtgatcacaggtggtataggcgtatgccatatttacgttgatgaaagtgtagagatcgctgaagcattaaaagtgatcgtcaacgcgaaaactcagcgtccgagcacatgtaatacggttgaaacgttgctggtgaataaaaacatcgccgatagcttcctgcccgcattaagcaaacaaatggcggaaagcggcgtgacattacacgcagatgcagctgcactggcgcagttgcaggcaggccctgcgaaggtggttgctgttaaagccgaagagtatgacgatgagtttctgtcattagatttgaacgtcaaaatcgtcagcgatcttgacgatgccatcgcccatattcgtgaacacggcacacaacactccgatgcgatcctgacccgcgatatgcgcaacgcccagcgttttgttaacgaagtggattcgtccgctgtttacgttaacgcctctacgcgttttaccgacggcggccagtttggtctgggtgcggaagtggcggtaagcacacaaaaactccacgcgcgtggcccaatggggctggaagcactgaccacttacaagtggatcggcattggtgattacaccattcgtgcgtaaataaaaccgggtgatgcaaaagtagccatttgattcacaaggccattgacgcatcgcccggttagttttaaccttgtccaccgtgattcacgttcgtgaacatgtcctttcagggccgatatagctcagttggtagagcagcgcattcgtaatgcgaaggtcgtaggttcgactcctattatcggcaccattaaaatcaaattgttacgtaagatcttatcattctcccaccaaaaaattatcttaatgtaacagctggtgtaagtaaattctatcaacgaagatcaatcttatctactgaccaaaaaggcctgatagggcttcgctcactatacatccttggctgcaggtttagttgtacaccactcctaaatttaatgtgttggcaatgtgttcaataaagctcgaacaaattagctcattatgatcggttaatacttcaacttctggttgcatgattgtttgtccgtaaaaagataacgcgcctgccgggtagtagcaggcgcattacgcaataggtaaacaagggaggaagttcagaaatgtaaatcgggaaggttgtacgcaatgttcatcgtactacgttgttacggctttgccgcaacaagccagttgcctgccgcgctcgcagaatgtctgcagcccggagataaggagattgttcctgccagctaaatcccttcctgtcgatacgaaccagctcgtatttttctaccagaaaattcacggcatcggctagggtgataccggcatcgatgtgttccttaatcacagcctcattgcagaatggcgtgtcgtttattgtcagaccatagtgctgttccagcagacgtgtcagtaacatttgccagacagccacgggtgacaggcagggcttcaccgcccgctgagttattgcaggtaaagttttcatgtttgctctcgtgtaggtaattaacgctgagtggggtaaatggcgatgtatacgtagccgcaactgccaagggtgtcggcttcgcaggttaaatcgttgtggtacagggtaacgcagtgggcatggtgggggctgagttcaccggtggtcagcatcgattccatctggaggataaagtgcgggaatgtttcatccagcttccggcattcgatgtcactgaacttgccggtgatgctggcccggtcagccagataatgcagtcggttgccttcctgcaccagacgggctcccaggcgcagtgtaatctcccgctgcaggcccctggtagggttgctcattacagttctccactattgtcagttcagggtgatgctcatcaggcaggtatagggcccattgcggtcctggcggcgttcggcgtataccgcgaggactccggcgatatccggaacgtccctgccggtgtaatgacagacgctaccgtgccactggtatttgccggtgcagtagcgaaagattcgggactcaggatgctggcggtatatcgtcattgccctgcgtttactgataattttcatgtaatacctcaaagcagaccgtgttctgcgaacgaatagatttgcctgccaccgacaatcagatggtcagggacacggatatccaccagctgaagcacctgaaccagtcgctgcgtgagggttttgtcggcctggctaggtgtcgtctcgccggaaggatggttatgcgcgagtatcaccgccgccgcgttgaagtgcagagcacgtttgaccacctcccggggatgcacctcggtgcggttaatcgtgccggtgaagagcgtttcatgggcaatcaactgattctggttgtccagatacaacacccggaactcttcccgctcaagcgcggccatatgcagtcgcagccattcacgtacggcgtgggtagaggtgaaggctacgccgggctcatgcaggtggcggtccagagccctgagcgcccgctgaatgagacgccggtcctgtggcgtcatctcgccgggtaaaaaggaaagctgtttcatctgttgctccttcggtcagtcgataatacgcagaatggcgtgagcctctggatgttgcatggcatactcccgcaggcggtaatagtgtgcggtcatcgcgtcacattctgtacggcaggcatggtggctatacgcaatcaggcagacagcaatacctgctgcttctgcactcatttgggcatcgttaccgttcaggcagttaaacagacgccatgtctcatcgttgtcaggctcgggggacataaatgcgccgccattgctgagggtgtagaacgaccagataccaccgctgtagccctcacagaagcggtccatccaggcgaagatatgcggctccaggagtagccactgcgggatagcgccaaagtactgtggccagaaatcgatacgctgttcatcggggaccggcgtgacggtcagttcaaattcgggttggttagcgggtgcgaggtcgtgctgcgtctgtgttgtcatgggtatgtctccgtcaataaaaacgccagcggcgatggctggcgtatggggatataaagtgtgttcggggaggtgaatgcgggtaaatgcttcgcgatcagcgggtggccgtgtctgtacggatgcctgaggtgcggatatagcggttaagaccttcaccggcatccggctcaaagttccatgcccgccagaccatccggccttcagtatcacgaaccaccagacggaagtgactgccctggtcgtcttcgagtgtgatattgctgtacgtggtagtgaccgcttgcgcttgtctccgggtgaaaggccccggtggcagcaacacggattgggtcattttcgggctcctgataaaagaaaaccccggcagcctgctagctgtcggggtgaatttgctggggaagatactactatcagtcgttgctgcagtctccgagagtggacagaactttctcagcgttcttccggtccgcagtgaaggtccctgctttgtggtcattgacgtagacgtcgaactgcccggcctcagagatattgctgatgaagtcaaaccaggcgttatcgccgttacgccagcccaggctggacggaataatgtactgctggtgatccatcactacggtgatagtagtgtcgtcatcgtgcgaactgaccatcttgtcatcggcaagggtaagaaagactgaatgctgatagaaaccattctggtccgggttccctgtgcagttgatggtaaacgtctttccgctggcttcggtcacgctgtattccgtattgccctgaccgtaaccctgctgccagaaccccgggatagcagaggcattaaagctcgcgagcagtacacccgccagcataaaccgacttagtgaaagtattgtcattcttgtctcctttgtcgttgttttattcctgattgtcagggttcgagggtatcagtagctgccccatcagtttgccgtcatgggcgtactcaaagtatttttctttggtatacgggtccgtcacctcctggtattccagtttgatgttatcggcaatacacagcgcattcatcagtggctggacggttttttcctgcatatccacgaggtagtagtaactgccatcctcgcagccatcgggcgactggcgggtacgtaaaacctgcaaggtgggaccggataagtagtcaacctgtgaccattcttcgctgacatcatcctggtggctgaccacatcactgaaacgcggtggggtgaggtccttaaatttactgatggccttcaggtcatcacttctgtcatcgcatgcgatgagaaacagagtggtggcaaccagcgccagcagaggcagtgttttacgtttcattatttttttcctgaaatcagacgaaccactttggcaaagacataaatgcccacgaaaatacccaccggcacgccgacgaacggtgtcagcgcgacactggcagcaccggctgcgccacctcccgtcagcagtgcggcaacagtggcaagggtcagggccgcgagactgtcggacaccccggttttgttcagaatgatgacgatgacaacaatggcgataatggcaatatccggactgatactccaggtccagatacatcagccgctcacgaaaatcacgccgcagcgtgcgcaccgacacaccaaactcagcggcaagcttacgcacactcagcgtttcccctgccaccagacggctgattatcagtgacagcctgacagccagccggtcatggcggcgttctgcctgtgtcatgagacgttctccgtgaaagttaactgactgaaaatgatgtgattactttaaagagggggtcggacagggtatggacaccacagaaactatttttcatttctgcaaaagccagaggcagcgggggttacaggccttccctcggtgagtgaggaccgtcagcacggtgcgatgcggacaggtggtgtccgatattaacaaagcagcaacattaaacggtcactgcagttgcgtgagcagggcttccgccatcacccacagtgcccggttaagtttcacgtccccgtcgataccgcgaacggcacgggtatgtgaccgtcctcctttggcattacggccactgagcccgcccttaatcaggttctcctgaatacgctggtacgtggtccacaggtcattgctctcatcctgccagcggcgaggggagaggatctgcgattcagtcaccggctggtggtcttcaccaaagcggtatgtgagggcggcttttgccagtgcctgctgtgccgggggtggcaacagcaacgactgcatggcatcccgtttctcctccacccggtcaaaaatccccagcacctcatacgcgccttcaatcacctgactcaccacgtcccccttgtgtggcacccgcacctcgccaaacgactcaccgcagacgagcccgttctgacaaaccgcacgaaatagtcccggcaacatctgatacgaactggttccatcgtgagagttgagtagaataatttccggcacctgtttaccggtgatctgcccttcccgccgcagacgcagcatatgctttgtatgttcacgacgacccgggtcacgcacgcgggtctgacaggcaaagaatggctggaagccttctcgctgtaggctgtcgagcagggagatggtgggtatataggtataacgctcactacgggactcgtgtttgtcctcactgaatacactgggcactacgcgaaacagctcttcacgggttaacggacggtcgcgacggataaggtttgctgcgccaaagcgcgaagccagacgggtcataagcagactcctcataacgggaaaacaaataaaagggatccccgtcgcatcggcgacaggggcagggaagtaacagggatgggttaaatactcagaagaagaaatcccagacggcgcgggccactgacaccaccgtggtgcgcacggcctgaatgacggcccgcaccggggcgggtatcaggggaaaggcactgatgctatcgagtacggccccgacggtttcaccaaaatcgctacgagcctgttcccggactaccgtcgtgcgaaaggaaggatggagttgcgacaccaccgggctggtggcctcacgtggcaggcacttaatcatccgctcggccatcaccttaagcccccattgtagacggaccgacacagcacacaccggatggacgggctggaacagctcatgcagcaggcagattttgcggctgatattctgcttctgcgccgtggacaactgtcccccaccgctggtaggttcggccttatccgactggctgataacaaacagcaccttatgccggtatacctctccaatcacctgatgataaaaatgttcatccaccgtcagcgcccggtcatcggccttaatcagccacagtaccaggtcgaggcgaggaagctgttcgcggtacagcgcagcatactcggtatcgcgagcgccactttcgcccacgccgggcagatccatcagcgttatatagcggtcgccgacttgcaggcgaaagcgcagtggctcacgtgtacaggccgccacatcgctgaccggtgatatatctccggcaaacagggcattgcacagactgctcttcccaacaccggttttacccataatgccgatcactggctcgtagttagttaactggttaatttgctgcagaagccgctctgatacccattgcggcagatcagcaagcgattgctgaaacgacttcaaaccttcagaattattcatcactactcctctgaaaaataataaaaaacggtagaatcgtgagattccgccgttaattgcgtatgttcagagtgatgatatatatctgaagattttttcaatcctctgcgcttgaggcagctgcgcgactgctggctcaggcaatgaatgagttataatagcagcatttactaacagggatttattgagagtatgagccgccgtgatacaccttaaaatctcaacccagcaaagtttcggagccgcgagcaaaagtgagagccttcacaaaataatgcttagtaataaagttactttgaattcagagccccgattaatgtgaacatgatcaacgaattttacccagattgagttcattcagtagccaggttttgaacacatcaagcgcagaatgcatgtgttggtgctgggggaaaaccaaataatgaccgatgtaatgtatttcgctggtactgtttacaagtgggcataccagtttaccgctagcgatttcacgttcagccagtagttttgattcaagcacaactcccaagccgtcaactgcggcagcaatcgccataaagctacggtcaaatcgaaggccataattattgggtggcgtcatcttattcgcctcaaaccatcctttccactggtacaactgcacatcgcactgaatcaatgtcaacgcatagagatcctctggtttctttagccgctcagccagttggggagaacacagtggcgtaagttcttcaacagcaagcgggatcttctcatagggtgatgggcggggttcaccgtagactatatcgagatcaaaatcatcctgttcaaaacgtgcatattctgtgctggctgaaagtcgcagatcgatgcttgggttctcacgtatgaacttaccaagacgtggtaaaagccattgatgggcaaaactcggtgcagtatgaaggcgcaaaggcctggattcatcagccgtcactaatgccaacccctgctgtaattcgttaaatccccgctgtatgtgctcaagcagtatttcaccttctttcgtcagcgtaatttctcgcgtactgcgctgaaaaaggcgtacatcaagcaagttttccagtttgcggatggcatggctgatcgcactgggtgacagttccaactcagaggcggccaacgcaaaagctccggtacgaccagccgcttcaaaggcgcgtaacagatttagaggtgcttttgctaagagcttcattcatgaatccttttcactagggatgaagtggtttactgaatttggccacctgaacagaggtgatatgctcacctcagaacaacacaggtgtcataatgaaaaaaagaaatttcagcgcagagtttaaacgcgaatccgctcaactggtcgttgaccagaactacaccgtggcagatgcagccagcgctatggatgtcggcctttccacaatgacgcgatgggtgaaacaattacgtgatgaacggcagggcaaaacaccaaaagcctcccccattaccccggaacaaattgaaatccgtgagctcaggaaaaagctacaacgtattgaaatggaaaatgaaatattaaaaaaggctactgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctggggcattgggagggcgatttagtctcaggtacaaaaaactctcatatagccacacttgtagaccgaaaatcacgttatacgatcatcgttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaatacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacaaccgcgctcttgatgtcagactccctgaacagttctcgataatcgggaaactcagggcgcgttatcctgtggccactctctgccatgtgttcggggttcatcgcagcagctacaaatactggaaaaaccgtcctgaaaagccagacggcagacgggctgtattacgcagtcaggtacttgaactgcatggcatcagccacggctctgccggagcaagaagcatcgccacaatggcaacccagagaggataccagatggggcgctggcttgctggcagactcatgaaagagctggggctggtcagttgccagcagccgactcaccggtataagcgtggcggtcatgagcacgttgctatcccgaatcatcttgagcgacagttcgccgtaacggaaccaaatcaggtgtggtgcggtgatgtgacctatagtgtgcccggagttcagggcgggcatggatgcttaaatgaaccgcgagtctgtctggaatattgaaccggtaactcacgatgagaaacccaacaatcccaccgggtgtgacggtggagaacctgagcggcagtgacctgcggcatgcccgcagggtgatgtaacccgctgacaacggggattgaggcgagatcactaagccgagatgatcctcaaggttaagtactgaaaggttgaagaacatgaacccgttaatccgcctctgtgggttgaaaacgtcaccacggcctacgtgatctgacaggccgtgcaggaggaactggcagtgatacgtaagcactgccggtcgaaggtgttttgacatgtatgcgaaacaccggggcagcagcgtctatcacgcttgcgttgctgacttctgccaacttgcggcaagcaaggataaagagtgcgacgggcagcctcctcagtatgcctgagtccaggcaggtaaaccggggaaggtcagcgacggatgttaagggggcatggctccgatgacgcgctggctggcggagcttccgtagtagtccgcgatggggaaagcccattacatggcgaagggaagcagtttgaatgtgtttgcgacgtgaattaactgacctaacgaggtgaagacctttgataatcagcgaaatgcaacgcaagcttgccacatgggcagccaccgatccgtccctacggattcaacggctgctgcgtctgataacacaaccagaatggctggctgaagcggcgcggatcacgctttcatcaaagggggcccatacccccggcgttgatggcgtgaacaaaacaatgctacaggccagactggctgttgagctgcaaatcctcagggatgaattactctcaggccactaccagcccttgcccgccagacgggtttacatccctaaaagcaacggcaaactgcgaccactgggtatccccgcgttgcgggatcgtattgttcagcgggccatgctgatggcgatggagccgatatgggagagtgattttcatacgctctcatatggcttccggcctgagcgcagtgtccaccacgcgatccgcacggtgaaattacagctcacagactgtggtgaaacccggggacgctgggtgattgaaggcgacctgtccagttacttcgacaccgtacatcatcgactgctgatgaaggctgtacgccgcaggatcagtgacgcacgtttcatgactctgctgtggaaaaccatcaaggcgggacatatcgatgtcggtctctttcgggcggccagtgaaggtgtgccacagggcggtgttatatcgccgctattatcgaacatcatgctgaatgagttcgatcaatacctgcatgagcgctacctgagcgggaaagccagaaaagatcggtggtactggaataacagtatccaacggggccgaagtacggcggtcagagaaaactggcagtggaaacccgcggtggcgtactgccgctatgccgatgattttgtcctcatcgtcaaaggcaccaaagcacaggtggaagccatcagggaggagtgtcggggtgtgctcgaaggcagtctgaaactcaggctgaacatggataagactaaaatcccccatgttaatgacggctttatctttctggggcacaggctcattcgcaaacgcagtcgttatggcgagatgcgagtggtctcaacgatcccgcaggagaaagccagaaacttcgccgcatcgctgacagcactgttatggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccggaggcgttatgagctggcggccctttttgtatctgattattaatccccacccgctattaagcgcccggcgcgggcatctgcgtctggtgcagggttgactttgcattctgttaacaaacgcggtataacaaaccttctttggatgtttagatgtccatacgtttagaaggttatatgcaaacaacacaacaaaatgcgccactgaagcgcacaatgaaaacgcgtcacctgattatgctttccttgggcggcgtgattggcacaggattattcttcaataccgggtacatcatttccaccactggagcggcgggaacgctgctggcctatctgattggtgcgctggtggtctggctggttatgcagtgtctgggcgagctgtcggtcgcgatgccggagaccggagcgtttcacgtttatgccgcgcgctatcttggtccggctaccgggtataccgtggcctggctttactggctgacctggaccgtggcgctgggttcgagctttaccgccgctggattctgtatgcagtactggtttccacaggtgccggtatgggtctggtgcgtggtgttctgcgcgattatttttggtctgaatgttatctccacgcgcttttttgccgaaggggagttctggttctcgctggtcaaagtggtcactatcatcgcctttatcatcctcggtggggcggcgattttcggctttattccgatgcaggatggctcgcccgcgccggggctgagtaatatcacggcagaaggctggttcccgcacggtggcttaccgattttgatgactatggtggcagtgaactttgctttttcgggtaccgagcttatcggcattgccgccggtgaaacggaaaacccgcgcaaagttatcccggtagcgattcgtactaccatcgcgcgactgattattttctttatcggcaccgtgtttgtgctggcagcgctgatcccgatgcagcaggtgggcgtggagaaaagcccgtttgtgctggtatttgagaaagtagggatcccgtacgccgctgatatttttaacttcgtgatcctgacggctattctttctgcagcgaactccgggttatatgcctccgggcgcatgctgtggtcgttgtcgaatgaacgtacgctaccggcctgttttgcgcgagtaacgaaaaacggcgtgccactgacggcgctgtcggtcagtatgctcggtggtgtgctggcgctgttttccagcgtggtggccccggacacggtatttgttgcgctgtcggcaatctccgggtttgcggtggtagcggtgtggctgagtatctgcgcctcgcattttgtttttcgtcgccgtcatctgcaacaaggtaaggcattgagtgaattacattatcgcgcgccgtggtatccgctggtgccagtattaggttttgtgctgtgcctggtggcctgtgttgggctggcattcgatccagcgcagagaattgcgttgtggtgcgggttaccgtttgttgcgttgtgctatggtgcttatttccttactcaaccccgaaacgcaaaacaggagccagaacatgtcgcagaataatccgttacgcgctcttcttgataaacaggatatcctgctgctggatggcgcgatggcgacggagctggaagcgcgagggtgtaacttagccgacagcctgtggtcagccaaagtgctggtagaaaacccggagcttatccgcgaagtgcatcttgattactaccgggcgggggcgcaatgcgcgatcactgccagctatcaggcgacgccggcgggcttcgccgcgcgaggtctggatgaagcgcagtcgaaagcgctgattggcaaaagcgtggagctggcgcgtaaagcccgtgaagcgtatctggcagagaacccgcaggcgggaacgcttctggtggcgggatccgtcgggccttacggcgcgtatctggcggatggctctgaataccgtggcgattatcattgtagcgttgaggcatttcaggcgtttcatcgcccgcgcgtggaagccttgctggatgccggggccgatctgctggcctgcgaaaccctgccgaatttttccgagattgaggcgttggccgagctgttgaccgcatatccgcgtgcgcgggcgtggttctcatttaccctgcgcgacagcgaacacctgagcgacggtacgccgctgcgtgacgtggttgcgttgctggcgggttatccgcaggtggtggcgctaggcattaactgtattgcgctggaaaacaccaccgctgcgttgcagcatttacacggtttaacggtgctgccgctggtggtgtatccgaactcgggcgagcattacgatgccgtgagcaaaacctggcatcatcacggtgaacattgcgcgcagctggcggattatctgccgcagtggcaggccgctggcgcacggttgattggcgggtgctgtcgcaccacgcctgcggatatcgccgcgttaaaagcgcgaagctgagggtttatcgggtctacatcgttcattgtaggcctgataagcgcagcgcatcaggcattgccggatggcggcacaagcgccttatccggcctacaaaaccacaaaacgttatgccgcatccgccagaacaaacatgccgtacggatggatttcaagataatactgctcgccgacgtccggttgcagacgcgtagcgttgacctgcaataatatctcctgcccgtgccattccaccgtcacttcatactgcggccccatataggcgacatggcggatcacgcagcgctggctctcttcgccgcgatcgctgagcgtgatcgcttccgggcgcacaccgaccatcccttcaccctgtgtaccaaagtgcagcgggcgcggcagatgatagccgtagatatcaacgtatccgtcgctgaaggttgccgggaacaggttggcatcgcccataaagctcgccataaagcgggaggcgggctggcggtaaagatcctgcggtgagccgatctgcatgatgtgtcccttgttcatcaccagcacagtatcagaaaccgcaaaggcttcgctctgatcgtgggtgacgtacagcgaggtgatatcaaactgcttttgcaactcgcggatcttgtcgcgcatgctgcgacgcaggttggcgtcgaggttactcaacggctcatcaaacagcagcactttcggcttgaggatcagcgcgcgggccagcgccacgcgctgctgctgcccgccggagatctgatcgacaaagcggtcttcgaatccttccagatccaccatcgccaacgcctctttgacgcgggctttcagctctgcgcgcggtacgccgagcattttcaggccataaccgacattctctcccagcgacatatgcgggaacagggcataggactgaaacaccatacagatatcgcgctgctgaatagagcgatgggtgacgtcttcgccatcaatgaaaatttgcccttcgctcggtttttccagcccggcaaccaggcgcaaaatagtggttttgccgcagccggacgggccgagcagcgtcaccatttgcccctgcgggatggtgaggttgatattgtcgattaccgtattactgccaaatcgtttagtgacgttgcgcagttcaacgaaatttttctgagtcatagtgcgctccattacgcctggtttttggcttttgaacgggaggtacgtgattcaccgatcagccagtcaaagatgaaaataatcgccagcatcaccacgatcagaatggaaccgtaggcaatcgctacaccgtattcgccatcttccacgcggttgaggatgtaagccgtcgctacgcgggtatccggcgtgacgaggaacacaatggcgctgacggtggtaatggcgcgcacaaagctgtaaatcagcgccgagaggatcgccgggcgcagcagcggcagcaggatgtgcgtaatggtacgcagggaaccggcgcgcaggctgagtgaggcttcatcgagcgatttatcgatttggcccggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacgtatccccactgttcgtccatttccgcgcagacgatgacgtcactgcccggctgtatgcgcgaggttaccgactgcggcctgagttttttaaatggcggaaaatcgtgttgaggccaacgcccataatgcgggcggttgcccggcatccaacgccattcatggccatatcaatgattttctggtgcgtaccgggttgagaagcggtgtaagtgaactgcagttgccatgttttacggcagtgagagcagagatagcgctgatgtccggcagtgcttttgccgttacgcaccaccccgtcagtagctgaacaggagggacagctgatagaaacagaagccactggagcacctcaaaaacaccatcatacactaaatcagtaagttggcagcatcaccgagaacacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacagcagctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgagatcaacaacctgtttgactgcttcagttttaaactcttcgggataacgcttaccgctcatgggcacctctctttaagccattttaaatgactcggaggtgtctgttaaacccgtggcgattcaaaattgcgatatatacatacccatgactgcccagcgtatcggcttcaccagtcagcccgttacggtacagtgtgacacagtgcgcgtacctgggattcagctcacaggagagcagcatcagctccagatgtgcgacaaaatgcgggaaggcttcatccagttgtagagtctgcacctcactgaatgagccggtgaatccagcccggtcagccagaaaatgcagacgatgaccttcctgcaccagtcgtgctccgaaacacggtgtgatatctcgtttaagcccccaagtttgagtagagtctttattcataattttattcctgttaaagaagaccatgttcggcgaatgagaatatttgcctgccgccgacaatcaggtggtcggggacatggtgaacactttttaacatcctttacccatggtgatcgactttttcttcaggtcgatcacccccactttcgtgctgtaccaccacacctcgtagctgccgtcttcctgcatctccttcagcccgacccgttctcccctgaacgccttgcctgcgctcagacttacccctttcacgctcagctttccgctgatatccactttcctgaccatcaccccttcatcgtattccgggggcgttgtgttgccgctgtactgccgcgctgacggctgataccgcgagcccggtaccgccatatccagcgcctcgtgcgggcgttcaaggttatagaccgtccgccagtggtcgaaggcgcgctgcagttcaccgctgtctgcgaaccattttccctgcagcacttccgccttcaggctgcggtgaaaacgctccagcttcccctgcgtctgcggatgataaggccgggagtgccccacccggatacccaggcgcatcagccacagctccagcgccgtccaggtgccggtggtgtcgccccacggtgagccgttatccatggtcatccggtccggcaggccgtaacgctcaaacacgctgaccagctgctgctgcacggtctcgcgccgttcatcggtacagtgcgccaggcacagggaaaaacgggagtggtcgtccagcagggtgagcggatggcagcgtccaccgccaaaaggaaagtggcccttaaaatccatctgccagaggcggttcggcgcgtcgtgttcgaaccggcccgtggcgggaatgcccggtgaagcgcccggcagcaggccatggcgggccatcaggttatggacggtgctgaaggcgggcatggtgtgcccctggtcctcgagccagcgcttaatcttgcgggctccccagcgttcatgacggtcatgggccatacgcagcagggccgtgatgtcgtcagatgagcggttcggggaatggtgcggaatgcgcgggcggtcctgaagaccggcggcaccttcctgagcccagcgctggagccacttgtagccggtggcaggtgaaatgccgaagcgacggcagagggaacggatgttcgccccgtcctgcgaggcgaacaaaacaaactcagtacgtaatgacatggtatctctcgcatcccagggcataagcgactccataaacgggttcttatgccttagttgtaagtgtctaccatgtccccgaacaagtgttcactatgtccccggaccgtacaccccaaaggggagaggggactgcaccgagccatcttttccccctcgcccctttggggagagggccggggtgaggggcaatatgtgatccagcttaaatttcccgcactccctcttcccttccgatttacctctccttgttctgcgtcatagtatgatcgttaaataaacgaacgctgttctataatgtagaacaaaatgattcagcaaggagatctcatgccgcagtccgcgttgttcacgggaatcattccccctgtctccaccatttttaccgccgacggccagctcgataagccgggcaccgccgcgctgatcgacgatctgatcaaagcaggcgttgacggcctgttcttcctgggcagcggtggcgagttctcccagctcggcgccgaagagcgtaaagccattgcccgctttgctatcgatcatgtcgatcgtcgcgtgccggtgctgatcggcaccggcggcaccaacgcccgggaaaccatcgaactcagccagcacgcgcagcaggcgggcgcggacggcatcgtggtgatcaacccctactactggaaagtgtcggaagcgaacctgatccgctatttcgagcaggtggccgacagcgtcacgctgccggtgatgctctataacttcccggcgctgaccgggcaggatctgactccggcgctggtgaaaaccctcgccgactcgcgcagcaatattatcggcatcaaagacaccatcgactccgtcgcccacctgcgcagcatgatccataccgtcaaaggtgcccatccgcacttcaccgtgctctgcggctacgacgatcatctgttcaataccctgctgctcggcggcgacggggcgatatcggcgagcggcaactttgccccgcaggtgtcggtgaatcttctgaaagcctggcgcgacggggacgtggcgaaagcggccgggtatcatcagaccttgctgcaaattccgcagatgtatcagctggatacgccgtttgtgaacgtgattaaagaggcgatcgtgctctgcggtcgtcctgtctccacgcacgtgctgccgcccgcctcgccgctggacgagccgcgcaaggcgcagctgaaaaccctgctgcaacagctcaagctttgctgagccggacgataacgatgaccattgagaaaattttcaccccgcaggacgacgcgttttatgcggtgatcacccacgcggcggggccgcagggcgctctgccgctgaccccgcagatgctgatggaatctcccagcggcaacctgttcggcatgacgcagaacgccgggatgggctgggacgccaacaagctcaccggcaaagaggtgctgattatcggcactcagggcggcatccgcgccggagacggacgcccaatcgcgctgggctaccacaccgggcattgggagatcggcatgcagatgcaggcggcggcgaaggagatcacccgcaatggcgggatcccgttcgcggccttcgtcagcgatccgtgcgacgggcgctcgcagggcacgcacggtatgttcgattccctgccgtaccgcaacgacgcggcgatcgtgtttcgccgcctgatccgctccctgccgacgcggcgggcggtgatcggcgtagcgacctgcgataaagggctgcccgccaccatgattgcgctggccgcgatgcacgacctgccgactattctggtgccgggcggggcgacgctgccgccgaccgtcggggaagacgcgggcaaggtgcagaccatcggcgcgcgtttcgccaaccacgaactctccctgcaggaggccgccgaactgggctgtcgcgcctgcgcctcgccgggcggcgggtgtcagttcctcggcacggcgggcacctcgcaggtggtcgcggaggcgctgggtctggcgctgccgcactccgcgctggcgccgtccgggcaggcggtgtggctggagatcgcccgccagtcggcgcgcgcggtcagcgagctggatagccgcggcatcaccacgcgggatatcctctccgataaagccatcgaaaacgcgatggtgatccacgcggcgttcggcggctccaccaatttactgctgcacattccggccatcgcccacgcggcgggctgcacgatcccggacgttgagcactggacgcgcatcaaccgtaaagtgccgcgtctggtgagcgtgctgcccaacggcccggactatcacccgaccgtgcgcgccttcctcgcgggcggcgtgccggaggtgatgctccacctgcgcgacctcggcctgctgcatctggacgccatgaccgtgaccggccagacggtgggcgagaaccttgaatggtggcaggcgtccgagcgccgggcgcgcttccgccagtgcctgcgcgagcaggacggcgtagagccggatgacgtgatcctgccgccggagaaggcaaaagcgaaagggctgacctcgacggtctgcttcccgacgggcaacatcgctccggaaggttcggtgatcaaggccacggcgatcgacccgtcggtggtgggcgaagatggcgtataccaccacaccggccgggtgcgggtgtttgtctcggaagcgcaggcgatcaaggcgatcaagcgggaagagattgtgcagggcgatatcatggtggtgatcggcggcgggccgtccggcaccggcatggaagagacctaccagctcacctccgcgctaaagcatatctcgtggggcaagacggtgtcgctcatcaccgatgcgcgcttctcgggcgtgtcgacgggcgcctgcttcggccacgtgtcgccggaggcgctggcgggcgggccgattggcaagctgcgcgataacgacatcatcgagattgccgtggatcgtctgacgttaactggcagcgtgaacttcatcggcaccgcggacaacccgctgacgccggaagagggcgcgcgcgagctggcgcggcggcagacgcacccggacctgcacgcccacgactttttgccggacgacacccggctgtgggcggcactgcagtcggtgagcggcggcacctggaaaggctgtatttatgacaccgataaaattatcgaggtaattaacgccggtaaaaaagcgctcggaatttaattattttaagagataaaaccgtctgcggaatatttcccgcagacggctttgttgtttttgaaatttattaatttaaacaattagttgagatatatcgttggcgtcacaaaagcaaaataacgtaattcggaaataagatatgaccattgctggttaattgaatagctcattacactccattaacacgatgttgtaattcggcacactacataagggtgtaattctgatgacgcaattaaccatgaaagacaaaattggctacgggctgggagacaccgcctgcggcttcgtctggcaggccacgatgttcctgctggcctatttctacaccgacgtcttcggcctgtcggcggggattatgggcacgctgtttttggtctcccgcgtgctcgacgccgtcaccgacccgctgatggggctgctggtagaccgcacccgcacgcggcacggccagttccgcccgttcctgctgtggggggccatcccgttcggcatcgtctgcgtgctgaccttctacacgccggacttctccgcacagggcaagatcatctacgcctgcgtgacctacattctcctgaccctggtctacaccttcgttaacgtgccgtactgcgccatgccgggcgtcatcaccgccgacccgaaagagcgtcacgccctgcagtcctggcgcttcttcctggcggcggcgggctcgctcgctatcagcggcatcgcgctgccgctggtgagcatcatcggcaaaggggacgagcaggtgggctacttcggcgccatgtgcgtgctggggctgagcggcgtggtgctgctctacgtctgcttcttcacgaccaaagagcgctacacctttgaggtgcagccgggctcgtcggtggcgaaagaccttaagctgctgctgggcaacagccagtggcgcatcatgtgcgcgttcaagatgatggcgacctgctccaacgtggtgcgcggcggggcgacgctctacttcgtgaaatacgtgatggatcacccggagttggcgacccagtttttactttacggcagcctcgccaccatgttcggctcgctttgctcctcacgcctgctgggccgcttcgaccgcgtcaccgccttcaagtggatcatcgtcgcctactcgctgatcagcctgctgattttcgtcaccccggcggagcacatcgcgctcatttttgccctcaacatcctgttcctgttcgtctttaataccaccacgccgctgcagtggctgatggcttctgacgtggtggactacgaggagagccgcagcggtcgccgcctcgacgggctggtgttctccacctacctgttcagcctgaagattggcctggcgattggcggggcggtggtgggctggatcctggcgtacgtcaactattccgccagcagcagcgtgcagccggttgaggtgctcaccaccatcaaaattctgttctgcgtggtgccggtggtgctctacgcgggcatgttcatcatgctgtcgctctacaagctcaccgatgcccgcgtggaggccatcagccggcagctgattaagcaccgcgcggcgcagggcgaggccgttcccgacgccgcgacagccgcatcccattaaccggaggcaatatggaaatcactaacccgatactcaccggcttcaacccggacccgtccctgtgccgccagggcgaggactactacatcgccacctcgaccttcgagtggttcccgggcgtgcgcatctaccactcccgtgacctgaaaaactggtcgctggtcagcaccccgttggaccgcgtgtcgatgctggacatgaagggcaacccggactccggcggcatctgggcgccgtgcctgagctacgccgacggtaaattctggctgctctacaccgacgtgaagattgtcgactcgccgtggaaaaacggccgcaacttcctcgtcaccgcgccctccatcgaggggccatggagcgagccaatcccgatgggcaacggcgggtttgacccgtccctgttccacgacgacgatggccgcaaatactatatctaccgcccgtgggggccgcgccaccacagcaacccgcacaacaccatcgtgttacaggcgtttgacccgcagaccggcacgctctcgcccgagcgcaaaacgctgtttaccggcacgccgctctgctacaccgaaggcgcgcacctgtatcgccacgcgggatggtactacctgatggccgccgagggcggcaccagctacgagcacgccgtcgtggtgctgcgttccaaaaatatcgacgggccgtacgagctgcacccggacgtaacgatgatgaccagctggcacctgccggagaacccgctgcagaagagcggccacggctcgctgctgcagacgcatacgggtgaatggtacatggcctacctcaccagccgcccgctgcgcctgcccggcgtgccgctgctggcctccggcggacgcggctactgcccgctggggcgcgagaccggcatcgcccgcattgaatggcgcgacggctggccgtacgtggaaggcggcaagcacgcgcagctgaccgtgaaaggcccgcaagtagccgagcagcctgcagccgttccgggcaactggcgggacgatttcgacgccagttcgcttgacccggagctgcagaccctgcgcattccgttcgacgacaccctcggctcgctcaccgcgcgcccgggcttcttacggctctatggcaacgactcgctcaattcgaccttcacccaatcgaccgtggcgcgccgctggcagcacttcgccttccgggcagaaacgcggatggagttctcgccggtgcacttccagcagagcgcggggctgacctgctactacaacagcaaaaactggagctactgctttgtggactacgaggagggacagggtagaaccatcaaagttatccagctcgaccacaacgtgccgtcgtggccgctgcacgagcagcccattccggtgccggaacatgcggagagcgtctggctgcgggtggacgtggatacgctggtctaccgctacagctactcgtttgatggcgagacgtggcacaccgtgccggtgacgtatgaggcgtggaagctgtcggacgactacatcggcgggcgcggcttcttcaccggcgcgtttgtgggcctgcactgcgaggacatcagcggcgacggctgctacgcggacttcgactacttcacctacgagccggtctaacggctcaggccgggtagcccagcgcgcgcgagagcgcgagcccggcctgctgaagctgctcgcggaaattagccagctccgcgtcgtccacgcgggaggtcagcgtcgacaggctcagggcggcgatgacgcgggactcgtggttccacaccggcaccgccacgcagcgcacgccctgctcgttctcttcgctgtccagggcgtagccttgctcgcgggtctgcgccagggcgctcattaaggcttcgcgagacgcgagggtggcgggcgtaaaggtagtgtactgatagccctccagcagggcgttcagctcggcctcgcccagccaggcaatcaacaccttgccgatggcggtggcgtgcaccggcaggcggcggccgatgcgtgaataggcgatggcggccagcttgccttcaatcttctcgatatagaccccttcacgcccgtccaggatccccagatgggtggtctgcccggtccgccgggacagctccgtcagccagccttttgccttctgccgaatatcgatggagcccacgacaaaatggccgcgctcgaccagcttcatgccgaggcgatacttgccgttctccgggttctgatcgatatagccgtgaagctgcagggtttttagcagcgagtggagggtactcttgctcagccccatcagtttgctgatgtcggtgatcttaagctcggtggcctgctcgttgaacaggtcgaggatctgcaacgcacgttcaacagactgaataatcggcataatgctggcatgtccacgctggaattaaggcgaaaacgtacctttttcgggatgaaaaatcaatgaaatggagccggtgttctccctctccctgtgggagagggccggggtgagggcaccaacgcgcagcggacccaatcactccccaagcgttgccatcatcaccgccttaatcgtatgcatccggttttccgcctggtcgaacacgatgctcgccgccgactcaaacacctcgtccgtcacctccatcccgccgtgcagatcgaactccttcgccatctgcttgccgagcgtagtctggtcgtcatggaacgccggcagacagtgcaggaacttcacgttcgggttgtcggtcagcgccatcatctgcgcgttcacctgatacccgcgcagcagcgcaatccgctctgcccacttctctttggcctcgcccatcgacacccacacgtcggtatagataaagtccgcgcccttaacgcctgccgccacgtcttccgtcagagtaattttcccgccgtgcttctccgccagcgcgctgcactccgccaccaggctctcttccggccagcaggctttcggggccaacaggcgcagatccagcccggtcagcgccgccgcttccagcatcgagttgcccatgttgttgcgcgcatcgcccgcgtagaccagcgtcatctcgttaaacgccttgcccggcaggtgctcctgcatggtcatcaggtccgccagcagctgggtcgggtggaactcgttggtcagcccgttccacaccggcacgcccgcatactgcgccagcgtttcgaccacttcctggccgtgaccgcgatactgaatgccgtcatacatccgcccgagaacccgcgcggtgtccttaattgactctttatgcccaatctggctgccgctcggccctaaataggtaacgcgcgcgccctggtcaaatgcggcaacttcgaaagagcaacgggtacgagtcgagtctttttcgaagatgagcgcgatgtttttaccggtaagcttctgtacttccttgccattttttttatcggctttgagctgtgcggcaagggtcagcagagaagtgaactgtgcaggggtaaagtcgagcagtttcagaaagtgttttttgtataaatcggacattttatcctcgcatggcgaacgccacttattgaattaaaattcactttatatgtgtaattattcatttgcaaccccatttcacaattctttcttacaaaggtggaggcaaacccgtccgtgtgtgaaaataatcgtatctgcctccgattctctgcagaagcagaaagacattggatcgaattctacaaccaggtcgagtcagaaatgagaatgattggccttctttatgattttaaggattatgcttctaaaatggcggagaacatggcgaggcttgctgccttacttcattacttcagcggtgatggaggcgatatatctgttaccgggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacgtatccccactgttcgtccatttccgcgcagacgatgacgtcactgcccggctgtatgcgcgaggttaccgactgcggcctgagttttttaaatggcggaaaatcgtgttgaggccaacgcccataatgcgggcggttgcccggcatccaacgccattcatggccatatcaatgattttctggtgcgtaccgggttgagaagcggtgtaagtgaactgcagttgccatgttttacggcagtgagagcagagatagcgctgatgtccggcagtgcttttgccgttacgcaccaccccgtcagtagctgaacaggagggacagctgatagaaacagaagccactggagcacctcaaaaacaccatcatacactaaatcagtaagttggcagcatcaccgaattttcagcccggatgtttcacgtacctatgtcgaatatctggccgataaggttgcggatcgagaagaggatgcagaggaatatctggaagcaatcatggaggctcgtgttaccgttgctggcatggggctggtgatggaggtgcaggattacttcgatggcgaggccgatagactggcgaaggcgtggctggccgagtacacaccgcaaatcaagtcgttgaaagatgagcgtaaagaggcctatcgtcaaatcgtcgaaatgagtaccgaaccgcaggatgtggatctggtcaggccggcgaacaagtttgaaatgaccagggtgcgtgaaggtgaaaaggaagctgaccttccagtctggaaacaccatttgttgtgtgacgaaagcgggaactatccggctctgttgaaccattgggaaaccaaggtttttgagatcgaaaccaaacgtgaaggatttgctttctggtatcgtaatccacagtacacagggcagtcgtcactgggaatcgcttatgttgaagctgaacagtacaagattgttcgtcccgatttcctgttctttgccgaacaggatggcaaaatggttgtggacctggtagatccacatagcctacatctggctgatgctttgcccaaactggaaggacttgcgctatatgccgaacatcattctgatgcttacaggcgaatcgaatctgtcgccgaagtaaagggtaaattacgagtgttagatttgaaacggcaggatgtgcaggatgctgttgctaccgctgaaaatgcagaaacgttatttagtagcggacttgctgatgactatcagtaatctatagaaaattgcgtaacgaaactgcattttagtaattttttgaaacaatacaaataaggccttctcactgagaaggccattaccgacttacagttcgatttggctacagccgaagttacggtctccttcaccaaacactttgctttcaactttggtcaggtagtccagtcgggttaacagcgcctggtagttctgctggaagtcagtactattggtgtctagcacatacttacagttttcaggaaaatggaccagaccagggtgatcgtctctctccagtctcagggcgctgtaccaggctcctgtgatcatccctctaaggttatcgtcctgatcgtaatccccgaggtggtagtaagcgtctttgttgaacaacaggcaaatgtgatagtggcatttacctgattcagaatactctttcgcccatataataaataaagggcaacggtaaatgcgtttatcctcacgcaccttacgggtacggtcagcctccagcttagctctgagggattcacgcatccgggatatcaccccaggttccaggttagggaagcaacagatattgtcaccgttatcaactattttgggatagtggagatcgacacgtacagcaattaacctaggataccggttagtcaaataacataataatttattaatcttactctgatattcgaggatatgtactccatgagtaccttgatatgttttcataatatatacctgtatttggtcctacggtctatagcagaccgtacagggatgccatacaggcagggctattcctggtcactgttgtcggtatatactggtatcagattttagtacggacatactgatctgattactactcttactggtgaatacaggtagtaagagtacacaatgccattatataatacctatccaacatctaaatttgagacgaaggtagccccagcctgtgatggctgttaaaaagttactctgcaattagcttctggaattaaccgatgattccgttattccagtgccgcttcacagtcgataaactgatactcaatttctttgcaatctcagcctgagtaaatccacctttcttaagtattgtgatatcacgtcggtatttgcttccctcctttcgtcctaattttttcttaacatgtcgatatcggcttttagttgatttcagattgtgaatgtcaatcgtatcctgacgagcaatcaaaaaagacaagcaactttcagcagaaggctctatccttgaagctggatggtagctgtagataaacatttctttttgaaggcaaaaaaataaaatattctgtaagtcctccacagttctgccaagacagcttagatctggaatgacaagcgtgtcctgccggttcatttcatgatgaatcaattgtctgagtaaacgttgctctgaaacaacctctttaatatctacctgctcgatcacaacatgttcaggtagaatattaaatttttggcatatctcagcaagtgagtgatgatctgtaatgctttcttgctgttcgctactgcatatggtgtaaaaaaatgaacgcatctgatgcactccggtgtcataaattattttttgatacctgaataatgtcattttgcataaaaaacaaccaaaaatagagagtgattgccagcgatactttaactggtaaagtagtattttacctctcataattgtttgtccttctttgttacctcttaggttctgctctcttgtgagtatgggtttataatgatgtcatccggtacattaacacggttggaaacatctgttttgcggagcactggcagcataaccaccatttcattgacatggtaaatatcaatccaacaaacaaccggataaggcataacaatcccctttcttctaagaacttcatttatcccgaatataatcaattgggatgttgacaagagtagagcctgcccggcatcaaagtaataaccctcaaaggttgttctatgaataagaataatgtttgaatatcctgagacactttgatgctttacatcaaaatgtctttgattgtaaatgtaaatggctttttccatatcgtaattttcccttagcgaggatagcctttcacgtataactgttttttcatctttccccatgaattcatcattagcgttcagttgaaagtaatctgcaatggggatttttaatggactcatgatgttcgttttccagattaacgaacagtactcttccagagttacttctgttttacctcggcttcgattgatgctttcttttatagagaactttaacaggtcattttttatttcatttattgaccagttatgacgattgcatttttctaatatagggatagccaaatccacaacttccgctattacggaagagtgagatttatttgttagtctggcataatgatcaattactcctaatgaagattgatttttgaacgtgactgagtgtttttttatgggagtagtctgtactacctgtgactcattgtttttgccttgacaaggtttttttcctggtagaacgctgctcatctcaaaattagtaacactattagacatttttaaggaaacctctttgttatctcaatataaaactactatctgaaatttctcagtgttgccccatttttctcggggcaacatcgctataaatcaataaaattaaatctgtaatttattacagactttctcgtacagaaaatgtatctataaaatcgaggacatctttacgtaaccagtaatggcggccattgatttgttttgggcgaggtagcccctcaggcaatttgtcctgacaaagccatttacgaatggtttgagatttgtagctaatgattttagctaactcagctgttgaaatgagctgtgattgagatgtatccgggagtttgaatgcgctcattttgccacctcagtgattgagatattggcaaagaaagctttaagcattattgaattagtaggggtagtaatgaaggcagaaggaaacgtttcgggctcggggtcggggtcactaccatcacctgaatctgatgataaggcacttttagctgatttagccgtactgtgatgcgatctggatgcctgatttttacatgacatcagacgcgcgagaaagttagtagcattttgcattctttgtttaagatgtaaaattttcagtttggcgcatgcgacagacttgcgaagagctgagtatgttcctttgagatactcgacaacctcttccatggacgcaggatcgttaaaggattgagttgttttacttgaattaatacaccagcgagctctgatagctgccagagtgggttctatggatacagttgctggggttgccattggcttatctcctgtgtagttgctgtatcattgactaaactgtgtattacgatacatgaaaatctatcttgatcaatagttgatgatattttgtaatatgttgatttttaatggaatcaacgcatatcaacgttgttttttatggtaatacctgcttcatttaagatccatgtctcaattttctcgtgccattttcgtaacagatctaacggacgacggcgatagtgtttttcggcaagagcgctgggtttgtgtcccataatttgagcaacaataccagtgggaacttcaacccactcggccaaagtaccaaaactacgacgtaaaccgtgaaggctgatatgtggtaactcagccagcactaatgctctgttgtgcgctgaacgcggctcaataattttgccacttttactgttacttctgaaaacccaaccctccttatttacgtcagaatttggggattgcgctagtacatttaacaattcagaaacataaggagtgagagggatgatacgttcaccttcgatcttgtctttaattcgcatgcttgaccatttgaaatctacgtctgaccagcgaagcgacgcaatttcttcacgccgagcaccagtgagcaaaagtacttggagataggccgatgcaataggattattgaggctacgcacggcactaaaccagctttttagttgttccttttgcaggcaatcatcagctttactcgctgacacgggaaccatttttcttacgttgtaatcttgtgccagatcgccaggaatgatcccttgatattttttctgataattactccatttgatgaaagcacgtagtaggcgataagcgtgagcagtgacggtaggtctattttgcctttctgtactcagccacgctgctatgtaatctggggttagctccgataacggcaggttgagcaaactagccaatggtccagccgaagtcgggccttggcctctttttttactttcgcctccacgactggacaagttaatgtgatcggcaatgtatcgagtagaatatgggcgtttagtttttgcactgataccggttctcaattcttgaagatagtcttcccaggcgacggagaaagtcacttttgttttacgtgattctgcctgcagggattctgcttctgcgatttttacagccttagcaattcgtggatctatccctgtatcgatcaatgtttgtaaccgtcttgcctcggctctcgcatcatcaatcttccagtcgttaatgttgccaatagtcatgcgaagggttttccccgcatatacgctttggaatacaaaggcttttgctccgctagttgctcggcatgccagggttgttacatctgcatcccaaagaaaagtttgttttttcccttccggtaaggtgaatctgcgaagtctttcgaaggtaaatttttgtcttgaaagcgccatttttcggctccagttgagaattgctgtcttacaataatgtaactgctggtgtaagtaaatggagggaataaacatcaacttttgttaatttcaatcaacgggtttattgctataacttggtgttttataatataaagtatgttgttttgattgattgctcaagtagttaaaaatgcattaacatcgcattcgtaatgcgaaggtcgtaggttcgactcctattatcggcaccattaaaatcaaagagttaccccatatttaaatacaccacgtttcctcctgtgccgtatttgtgccattgtaaccttggcaattcatcaaaatactgttctgacatcaggcagtgcaggtgcagacatttaagccaattgctgccgccattctttgacgtagtcaatcagggcgcggagctttggtgcaatattgcgacgctgtgggaaatacagatagaagcccggaaattgtggaagaaagtcatcaagcagcgatacaagcttaccgctttcaatatatggcctgaaagtttcctgagtggcaattgttattcctccgccggcaagagccagcctcaacatcagacgcagatcattagtcgtaatctgcggttcaatcgcaaggtcgaaagttctcccgttttcttcaaatggccagcgataaggcgcaacctccggggactgacgccagccgatacacttatgggtatttcccccggaggcgagaaagcactctccacgcccggccgcaaggatcaggacgacgggggcaggcatgaatcctcctcctgatggagacgtacagaggcgacttctgccagcacggagagtgccagagtatgcgcatcccgggctttggggaatatcccgacgggtgcccggatttgcgttgtttcctccctggaccatcccagctcgtggagcttttgcagacgtaacgtgtgggttcgatagctgcccaatgcgccgagataaaagggttttgcttctcgcgcggcctgcaacactggcagctcccggttgagatcatggcacagcaaaatgaccgccgtatcggtatcgatctgagcgctggctgaggccggaaaaagatcgaagatatggctgtcatagcctgtggctgctgcaagactcgcggttgcctgcgcctcaagagaacgtccgtaaatcatcagcctgacgcatggcctgaaccccacctcaaagccattgagattccagcccgtccgggtttgcgtgggcaggcacaccagcgattgtgcttgcggatcgtagcgcagccccaccggttttctctgttccaggcggttcagcacggcgagcagaggctgtgccgagcgtagtttatggagcgtcagcgtgatcccaccgccgcagggcagaacgatgtcaaaccacggcgaaccttcgccatagcgaatttcgcgatcgcggcctgagcccatcatctccagcgcttcaaaagcggcagcggcctccacgcagccgccagagacaaaaccgcagtaacgaccatcttcgcgcaccaccatctgcgccccgagcgggcgcgccgcgccgccgcgtatctccaccagcgtcaccagcaccgctcctttaccggacattagcgcctctacggcgaagcgcagaatggtccggtggtcatcggtgagaaacgcctgctctggcttatgccagtgttcgtctttgtcaaaaagcgggtatgacattgttcctccttaaaccacatccggcagcttatcgagcagcttatccagagtgatgggataatcccgtacccgaataccggtggcgttatacaccgcgttggcgatagccgcgctcacgccgcacaggcccagctcaccgacacctttggccttcatcggggaggatatggggtcggtatcatccaggaaaatcacctcctgttttgggatatccgcatgaaccggcacctcataccccgccatatcgtgattaacgaagtagcccaaacggtcatccaccgccagctcctccatcagtgccgcgcccatgcccatagtcattgcgccaatgacctggctgcgcgcagttttcggattcaggatgcgtcctgcagcacacacagcgagcatacgccggacccgaacttctcccgtcgcgctatgcacgccgacctccacaaaatgcccggcaaaggtcgactgctggtactctttgctcagtgttccgaattcaatgctctcttccgctgtcagtctgccgcctgcggtggcttcatgtagcgtggcgcttcgggtaccgttggtaatcttgccgtcggcaaactgcgactgctcaggatcaaacccgactgccgaggcaatcatttcgcgaagcttcatacaggcggcgtaaacgccggaggtggaggtattcgcgccccattgtccaccagaacccgcagaaaccgggaaactggaatcgccgaggtgaaccgcaacctgctccagcggtacgccaagcatttccgctgccgtctgggccagaatggtgtagctgccggtgccaatgtcggtcatgtccgtttctacggtaacggtgccgttttgttcgaggtgaacccgagcacccgatttttccagcagattattgcgaaagcccgccgcaacaccgtggccgactagccactccccgtcgcgcacctgtccgggtgtggcgttgcgctgcttccagccaaatttatccgctccggtgcgcaagcactcgataagctgacggcgagagaagcagcgcgtcgggtcggcggggtcaacctgagtgtcattcaggatgcgaaactcgacgggatcgatgcccgctttttccgccagttcgtcgatcgcgatttcgagcgccatcagaccgggggcttcgccgggcgcacgcatggcgttcccttccggcaaatcaagcgtggcgagccgcaggccggtatgacgattcgccccggcgtagagtaattcgctttgctgtaccgccgtttccggcgtgccgccgggcaggtttccagaccagctttcatgtgagatagcggtgattttcccgctctggtcggcaccgatacgcaagtgctgaagggtggcggggcggtgcgtggtgttattgggaatagaggggcgggggagcatcactttaaccggacgtttcaccgctcgggcggcgagggccgccagcagcgcatcgcttctcaggaacagcttgccgccaaaccctccgccgatatacggggagataatacgcacattctccacgggaactttcagcgtttttgccagatcggtgcggcaccagtcaatcatctgatttgaggtccagagggtaagcttatttccatcccagacggccatcgaggcatgcggctccatcgccatatggctctggtccggggtcgtgtaggtagcatcaatcttcaccgcagcggaggtgaaagccccgtcaaagtcaccgacgtttttgtcgggcgtgtcttccggcggctgattgacggcctgtttttcgtccgccagggagtaagctcctttattacggcgatagtgtgcctgcaccagcgaggccgccgctcgcgcctgttcgaaggtctcggccactaccagcgcaatggcctgatgatagtgctcaatagtggggccgcctaacagcctggcggtgtttttgtcgcctttgccgagtgccccggcgttactggcggtaatgacagccagtacgcccggcgctttttgcgcggcgtccgtatcaagggcggtgaggcgtcctttggcaatggcggaaccgacgatatagccataggcggcgttgggggcttcttcatgccattcgtaggcgtagcgtgccgtgccggtagttttcagcggtccgtcgatgcggtcatggggacgaccgacaaccttcagctgatcgatcgggttttcccctgcgggtttatcaaatttcatgcctgtgccctcgcttcagccagtacggaggcaagcgttcgcttcgccaacaggagtttaaaggtgttttcagcggtgggatgggcgctggcgaacagcgtgtcatatacggcctgcgccccctgggatagctgagcatccgcagcctcaatgcgccagggcttatgtgctactccgcccagcgcgacgcgcccgctgccgtcaggctgaataatcgccgcgaccgataccagggcaaaggcgtaggaggcgcgatcgcgcaccttacggtagatatgttttccgccgagcggtggaggtaacgtcaccgcaacgataagctcaccgggaagcagggcggtttcaatgtgcggcgtttttcccggagggtgataaaaatcagccagtgtgatactgcgagtctttccctccggcgtgatggtttccaccaccgcatccagcaaccgcattgcgaccgccatatcgctcggatgggtggcaatgcaggcttcgcttacgcctaccaccgcgtgctgacggctaaagccttcaagcgccgcgcagccgctcccgggcaggcgcttattgcagggctgattggtgtcgtaaaaataggggcagcgcgtgcgctggagcagattacctgcggtggttgcctgattacgtaactgaccagacgcgccagcgagcagggcgcgggagagtaccgcgtaatcacgacgcacgcgctcgtgagccgccaggtcggtgttccgtaccagtgcgccgatgcgcagcccacccgcgtcggtcacttcaatcttatcgagcccgaggccgttcacatcgataaggtgggtgggcgtttcaatttccagcttcatcaggtccagcagattggtcccgcccgcgataaattttgcgccgggtacgcgctgagcgctaagtgccgcctcggctggggtattcactcgttcataggtaaacgccttcatgattttatctcccccgcagcatcttcaatggcggcaaggatgttagcgtatgcaccacagcgacagatgttgccgctcatacgttcacggatctcatcggcagttgtttctggagcggaaaccaaatcgaccgtgacgtgactgggaatgccgtcctgaatctcttttagcaccgctactgatgagcaaatttgcccggaggtgcagtagccgcactggaagccatcatgcttgataaaggccgcctgcatggggtgaagattatctggcgaacccaggccttcaatggtggtgatctcggccccctgatgcatgactgcaagcgtcaggcaggcattaagcctgcgaccattgaccagcacggtacaggctccgcactgtccgtgatcgcaacctttcttggtaccgatcaaatgcagattttcacgcaaagtgtccagtagcgtggttcgggtatccacctcaagctgctcggttttgccgttcaccttcagtgtcaggggcattatctctggcgcgggtgtagctgccggaacgcttgccgccagcgtagaatgaggataaaccacggcggtcgccgctgttgcggcgctcactttaatcagatcgcgacgggtcaaacttaaatcgtgcggctcgtgcttcccaacccgattatcttcggggtattcgccttggttgctcataccaggcctccggtattctaaaggggaaaataagagtgcgttgcgagagtgctgatgcttttttaaacgttaagcatagtcggcgacagcaggaggattattcttaaaacgcgaatgcagctatgagcccggctaataaattcatgttcgccgggatgttgatgatgatgggagctggtttattgctttagttgtacgatgcaaaaaccaataaggaaacctgtgattttcagctctacatcaccctgcaaatctctgtcacttctaatataaaaatagggagaaatgatggagcttatattcattggcgattaggaaactatcttgttatacaaaacaatacagttctttacatttgccttgttttatgaatactcctgaagaggtgtataacataatggtacaagcagggtagatatgaatatatttgaacaaactccaccgaaccgcagacgttatggtcttgctgcattcattgggctgattgctggcgttgtttccgcattcgtgaagtggggggctgaagttccattgccgccacgtagcccggtggatatgtttaatgcagcgtgtggcccggaatcattaatcagggctgcaggccaaattgattgctcgcgtaattttctcaatccaccgtatatttttcttcgagactggttggggctgacagatcccaatgcggctgtttatacctttgccgggcatgtctttaactgggttggtgttacgcacattatcttttcgatagtgtttgctgtcggttattgtgtggtcgctgaagtatttccaaaaattaaactctggcagggcttactggcaggtgctttagcccaactttttgttcatatgatttcattccctctcatgggactgacgccacctctgtttgatctcccgtggtatgagaatgtttctgaaatttttggacatttagtctggttctggtctattgaaattattcgcagagatttacgaaacagaattactcatgagccagaccctgagatccctttaggctcaaacagataatgcattgaatgataaaaatggcgcaaatacagcgccatttttataggttaaaaacattgctttttatattctgatgcagatagtcagtgagtatatcgcgctacttcaggatgatgtagatccgaagaacgctacagaagagaggcattgttgctggcaaatagaagaagtatcgggttttgttacccctgaaaaacgaagccccgctattatcgctggcggggcagtgcaattaattattgtatgtttataacggtgtcagcccgtatttagcccttgcacgattgcaagcctcattgacgactccgttctcaccagacatggcgaattctctgcatgtggacgatcgatttttatatatcgtgcagcaggcatttttgcccggggttcctgcaagggcaatacatcgggggtttttctgattggtaccgctcatgcatcggtgaaaaggggatatttgttcagtgagcctggcgggaatagtaccgccagcatcgtcggcttcggcccagtaaaaagagacgcggaaaaatgcacaacaggcaccacacgtcatgcatggattcagattgctcataattcaccagtacagctaaaaatcgtaaagagaacagcggtacatcgtatgtaagaacgtaccgcggttggctggggaactttcgatagtgtgagtattgaatgatttccagccgttaccgattttacgtactaattcgtgattaaaccactcgttagcaggctgcctgatacctttccgtgtctcctgaacactatggtgtgcatatgagaaagcccatcgttacaggtgatattgacgatcgcttccacatcatttaaacgatttttggggctctgaggtggaattcttccctcgaccgatggataagtcttagtccgccgaagggggcttagccggacaggaatcgctaatcttaatgaatttgtcgttatagaccagatagtgattccccggctgacgtaactcaggctgatgaaccacgtctcccggacgtagataccaggcatcgccttcctcttcggtcgaatcacatcctggcttaatcagtagcttaaaccatgtgttgccagtgttacttaccgttcctgtcaccttgtcgaaggaccatttaaactgaacctgacgtggtcgtactaccagaatggtatccatcaccaccaccggctccgtgctgaccacgccgccggttgggctgcgtcttgtatggttacgagtggggacctcgcgaaatgagacccggtagtagcgctcgcggttatcccgtggaccatgatagtaaaatttaaaatactcgctctcaccagcctgcaacgccagctggcggggggcgaaaagcagttcaccatccaccggtcgggtgcgcaattcactgctgcccgggctatcaatagcactgatggcaatacggtatatccgtgcgcttttgttgttattcactacacgtttgctgacaaagtcagtctcggacggcagcgaaaatgtcagattgccgaccgaaatcgcctgtgtcaaaggtgccgccagcatacagaccgctgtcagcagggccttagttaatgttacgccacgtcgcctgaacatgaatctctcctgaagcgctgacttcgccaaaccagccgttatcatctaccgtacgcagcgaaatggcgttatccattggaatcgaaaatttgactgtggtcttatccatctgccccacttcgccagagatatcagtccacggtgtggtcaaccacagcgcatcggtcatatcccgccagctatcatcgcacccggcatcgtaggtttttgtagctccgttgcgggtaataaaggaaagtgtcgccgggaacggtactttcgccttaccgtcatcggagctgaagacacaataggagcgcccgccaatcacctgcgcgggtccggtcaccttgatcagcacttcgtcggcagctgttttaccgctggtggttacgatatagccgaaatcgagtgccgactcgccgctgccaacatatccctcccgcgacggtgtctgagtatattcatcggagataatactgatgctgaaatcacggggtttgataatcagcgtgttggaggtagaaaattcataccagccagactccggtgatgtggtgttctgaaagcgaaagttgaatagatctttggtgttgatatcgctgatcccgaggttcaccatctgcttaaagaagttgctcgagaagaaaacatagatcgagtctgcgctcttcatctcgttgaaggtgtagtaataggcggtattgctcaccggtttccatgaactgccattcagactgaactgcatatcgtacgccccgacggccgaggctaacgacgagttggcgatcgccgggaatatatggattgaggtgttgctgagtccgtttgtttgcagggtatagttaaccatcttacaacttaatcctgaacggctgccgatggtttgcgtccggcagtcggcgttcccttcgcccagagtcggtactccgtcgctgttgataaatacttccgccagcgagtgggtatttatcaaccgtagatttgctgctttcgtatgggtgacgttgcgaacataccagttgccggaggcctgatccttacagcgtgcgccgctgctggcgtcatagttcacagaggtctggcaggcattgatggtcattgtaaagctgctgccgacgggcatttgttgcatatactggtaaaacgcgtctgacaacatgccgtgcatccacttcgcgccgccgctggtcaccgtcgcgccataaaatccactggcgtcggtggtttgcggcaggataagactggtggtcatattacacccagcgtaccagttgatgcagcgcaagccagttaaaggagatgaaactggtgaattttccagccacatatcaaacttccagttggtataaaggccggtgttgtaaccgttatcaatgtagccgaggctttgctgatagatggttcctgaaccagtgtattttaaaccggtccagcggttggcaccggtcaggcgcggatccagcgccccgccaggagtgacgaaaaagttgtcgtctgagttgttttcgacaaacacaaactcgcgtgccggtgcatccgcccaggttgttttgctcactgccgctctgagcgcagttactggccagattagcgcgaaaattatcatcgttattagtaggttaactctcattctcttctcctgtctgcgtcaccgccgcccacgatgagaggccgctgcagaccacatcaccgacccagacggcaccgcgcgcctggttgagttccagagccacttcgcaggttttattgccactgtagcgaaaatcgatagtggggtatttcttatccacgtccatgacaaactcgccgttttcatcggttcgggttcggccgatatggttgttaatccgtgcgttagccagcagtgtgccgtcttccgcacggatacgaccggagacggtaaccatctgcttcacctctggctcaatgacagcgacattgcctggatagagagtcagacgacttttgcggccgctgacgatatcgtaactgtcgagtgagtttttgctgttctgtaactccacctcatatcttccatagggagagagcgggagatagttacgcttgccgttaagcgggaaaatccgcccgttgattttggcgctgatctgaccgtcgtcctccagcccggtgttgaatatcaccccagcgttgccatcagtccgcccgctggcagcaatgtttttaccctgccagccgacgctgccattggcggtcaagttggtattgacgtagccgtccgccgcgctattgacgttcagcgttccgctggcgtaacgagcgtcgaattgtgcatacgccccgccgctgagggttttgtcatcaccggtatcgccggagatggcacgtgacagattggcaccaacagtgcgaatggttccttcatcaaactgtttgcgtgctgacaggtttgccatggtgtagccgttttgatgagtcatccctgcgctaaaccagttgcccagtggtagcgagagatcgagagcgatatattttcctgtattggcgttgctgtcgccgttgttatagcgctgaataccggcccgcaggccaagcgaaccaaaggtaccgctgtagacattttgatagtaatctgccgtgtaataatggctgttgtaacggcggtcatcattgtagctgatgctgaatgtgcccagcttcgaccacagtgagttcaggttgagtgtgccgccgattgcacggttgtcggcatcgctacgtcgcaattgattgccaatgcgggttttttcctgattaacccacagcgaactaaagcctcccggtagagtggcgctgatgctgccgatgctgctccatgagctgtcactggccagcatattttgcaggttaacgttgatcgcccccccaagcggcagcgtcagacgggtttcacccaccgcctgattatcgtatccatatcccgttgccgcccagctaagcgtactcaatgagccggaggtcgaggcacctgctagccaactctctttagctggtcgcgtctttttcccgttttccgaccagcgatccatatgaaagctaccgccccatacctgccacgccagtggtgcaccgacgccgcgcccccggctaaacagcttattgacccgctgggtgcgtttgctgatcacgcgaccgttaacgatcacctcaacttccacatcgtaaatcccgtacggtagaccccgggtatccacttcatgattgcccatagtgaagttctgaacgcttagtagccgcccatcacgggtgagatgtacttcgcccgccgccggtaaaaaggcgatcactggcgtggctgactggctgctgtcgaagatggtggagctggcctggtttccccaggaaaggccgtaaatcttccctgctgaaatggcggtcatcggccctaaggactgcaagttccaggtgtcgagcattccaccggcaaatcggtgaccggcaaaatcgcgttcatacatcgctttatataattcactgtcctgttgaccgctaccgatcccgtacagcgagccgtcgagcaccacatgatgttcgcgcagtgcagtaacgttattcagcgacagatagctggatgtgttgctcccgccgttacgcaactggttgttatagacgcccaagttatagctcagattactgctgagggtgttaacactggactgcccgatgtcttcgctacgtgagcgtagtacggtgcccagcgcttcgcgcttgaccactagctgcagcagcagttggcgcaagctgagatccagctgcgcgttgtcagtcagggggatggtaagggcctcattgaacggggcgttggccagagccatcagctgctgtcgagtttgttcgctgacactggcgttatcttcactctcttccagctgtattttccggatgcgtagctgtccatcgtccagccagataaaagcgctgccgattcgctgatcgtcctggcgaccctggctaccggcgagatgaatatagagcgggacgctcatgccgtcctgaagcgcctgactgaaggcctgcggaataatcaccccacctatttgctgcgcacttatgtcagcagcgctggcatcgggctgaacgaacaaaaagaccatgccgaaggcaaactgggctttcagtcctggggagaaccgtcgtaaaggcattgtcgttatccatctgcacagctatctatttcacgggaatgaacttatcaccctgccaaagtgcaacccgtcctttgttatccgcagtgtccacgcgggtaaaacgacgcgacttgcccggcatcaggtagtaattctctttacactccttaccgttggcggctttcaggcaaggtccgtaggcgaggatccgcagcgtcgcatttcctgtatttgtcagggagccgttggcgtactgaaagtggtagttcgcctgacgaggggcgacgaccagaatggtgccgatgcgggcggaagcagtggccacagcgctgcggttggcattatcgcgctgcgcatcactgagggcctgatcaaaccagacaatgcggtagtagcgctctttttcatctgcgggtcccttatagaagaagcggatcacttcgctggcttgggcgggtagcagcaagctggcgggagtgagtagcaactcatccggcttgtccattgagataacctgcccgtcgtcaagcggtgaagagagccgttcgagacggatattgataaggcgaccactgtcggtactgtttttgatcgttttgctcagcgtgctgctgtcactgttcataaacgatgatatatcgccgacatccagcgcctgggccggagatattccggaaaacagcagagcgagaggcagaaggtgctttttcataacaattccgtccaggaataaagcaggggggctacccctgctggtacatcagagagattaactggtccaggtcgcgtcgaactgtacgctaacgtcgccgctccagatgccttccggtagagtgctgtaatctgttactgcggtggtaccattggtggtaccgctgatgatggagaaggtgaaaccatcctgtgcggtggtacgattgctggcattgtaaccgttagccagcgggctaaggttgccgcccagtacgccgttggcggtatcgatcatcacggtatcgccagttttttcgactgccgcgccgttataatccacgcccacattcagtgtggaacctgaggtatccaactgggttaatgtgttggtgataagacgtgaggtcagtttaaaggcggtagccgttgagtcaccctcgatagccacgtcaaatagacctttctgtgagttaaaacctttaatgccttcggcatactggaacgccaggctaccgagtggcgtcacaaccagcttactggtggtgtcttttttggctgttgccgaccaggtcgctacagcctgagctgttacgtcagcagcctgcgccacacccatgccggtaaacaccgttaccagagctattgccagaaccttttttttcattgcatttcttcccgagttgaattgaggacgtgatgtcccagtgagtcattttttaaaactaacttgcctggagtttactgaaccaacttatatatttttgagtacagcttggcctcagcattacgccgatgggtatacactgtcttcacactacaattttcaattctggcaatcgatttaggttgcattccctgggccgtcatgcggataatttccatttcccggtccgtgattttatctttcttaatatcttttctcaggaacctgccattaatcacatagaccagttcttttctaatatcacgactcagtccagcgtataccacgcccctaatattgctattgtaataccaataatttgctaaggcctctgactttctggccgcaatcaatacgacctgtttcccctttaccgcggataaccattcattatcacggtttataaattcagataaagaatccgtactgagattgataaacacgaaatcttttctaattttctccaacgatagataaattaatctgtcgatatccacaatcagttcagatagtcctttatagaagtaggcgtcatggggagaccagatgtatttatcagaacggttttgacattccatatggtttttaacctcatagtccctactgtaatcactttgccatgtcactactttccaaacctgtaatttttacaggtgcattcagtttccttagtaaaccggaagtaaataagatacgtagtacatatcaataaaggttaaacgagattaagtttaattattttcgattgggcttaaatttatgttttttttcccgatgagtgtcaatatgtgaacggaaaaggaattcaatggttaagtcaatatttagaaaaactgaaaatattgcttttttgataagaagaaaaagacatttggtttcataaggttattggcaatataacgttcaattcttacttgcattttatattggtcaggaactttgccctgaagtgttaggaatagtcttaatgcgctgtgtgatggactagtaaaaaaacaagttttaagggtaagggatagaatataaaactatgatgagctgtcattgaagatgatttgccaatcagtaagatattttaatggattaacatgccgcacaaaatggttacaggtgttcattccaataagtaatggaaaattgaacgggcgtatgtacgtcatctgttcggtaagcccccaagagccagattaagtgaagttaaacgaaggctgccagctgtcacaggaacgatggcctttttgtcagggcactgcattcagttatctgtgcgcgttactctaactggcactcgaacgtcggcgacggggttaccggtggatcagactgttcctgtggcgtaaacgtttttatgttagtaccaacagatttaccacatttatcatcttaacagtttgagtgaaaatgcaggctgcgccgcaaagggaggagactgagtggcgtgttcagtctaaaagagggttgatgccagcatacaggggcgaagctggtcaacaagtcaacattaagataatggaatattcggagagaaacgtcaggcagttggcctcaaatgaacaggaagaatatatccccaggaaaattaatgttggtgttataaacacaccaacattaatccgatctgattattaatcagacaaatatcgttaatccgtcgaattttgaatcaacgttttttcttacgaccctgaacggccttaaaacgtggattagatttacaaatcacatatagccgtccttttcgcttcacaatctgacagtctggatggcgttcttttgcggtacgcagagagttaagaactttcatcacgccccctttttcgtgctaacaaaacgaccaaaacgttgggtgaatcgtgcaacatttccttctgatgccactgttctcagcttccctgtatagaacgggtgcgatttagaagagacatcaattgtcacgtatggatacgttacgccatccagctcaatctcacggtctgttttgatagtcgagccgattttaaagtactcatcaacactggtgtcgtggaacaccacagtacgatactcaggatggatattgggcttcatcatttttacctgttatgttataacataaccataaagatacatgctcatccggatcatttcaacactcaatccctgtgactctttgtggatgtggaattttcgcaacggggaactctggcattgttagcagccattggtgacgctcccataaacgcctggatgagtgattgatgatggttttgctgagagtatggatttttcgagaatggaggttatctccactttactggccgataatttatcgcagtatgattgattacctgacagcgtgtattcctctcccacggatataataattacttacaaaaaagggagaggatgcatattttaaatatcactgaagtgaacagtttatttccgttattaatagaaatggagaaataaataggcgtattctacaattgcgacaaaaacaacgatattaatcagtttatgactgatttgctgtactttattctctttcattggtacttcctcgctttaaaaaagagtgcacttcgtaagtgcccttatataaataacgagtttggtcaaccaattttttgacatgtatcacaaatttgaatagatgtattacatcaactatcttttattgcaccaacgtcattgatatatgtcgcctgaagtcagttccgggaatgagtctgatctcaagactggcccagtccgggcgttgattggtgctgaggagcatatcgcatctcatcataatgtcgtatctcctggggtgttatacaagatatcgttgttggtgacctgggagaggaattgagttctattaaaccgtcaactatgccggatacatactggattacactgcaggcacgccttatgagagaacgtgccgcagtgacgggttaattatctgaaagaatttgtgaggctgtatcggttactcattgatttgatagttttactctcgggagaataatagatatttaatccattaacggaaaccagccagttcctttcgatgcctgaatttgatcccatagtttatccggaatggttaattcatgaacaagttgtgttatcgttcatgagaagcataacgtaaagggaaaagctcgattagacggcagaatttgtcaggggttatgaacgaaattcataaatctgtttgagtgttgcgatgggtagtgcaagttcgatatctccgcaatttacagtccgatgaaggaaaatgaatatccataaaaaatatattggtttatcctggcatatatacctatttcgacgtatttccaatagttttaattaaaggcaggtcattgttattcactctgaatagtgaattattcactgtccgcagagtaagaaatataacttaggtatctatttaatgacttgcacaaaaagctaaattttcccccataaataaaaatataatcccgcgcccaaccacctgatgagtggctataggcactggatatattaggtggcggtgcactttcttacataaaggtatttccttttctgcggaaaaggaaatcgggaaatccccggtttttctgacaagcagacgccattatttgtgtctgcctatgttcgttaattcgttcatcaggaaattatctcaatgtcacattataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaatacttttatcgatcatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggctgggatattcgtgctgagggctatttacccgcctggccgcagcttggcgcaagcctgatgtatgaacagtattatggcgatgaagtcgggctgtttggtaaagataagcgccagaaagacccgcatgctatttctgccgaggtgacctatacgccagtgcctcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcataaagtcctcgggtcgttgtccactcttttggcatgtcagcatattcacataccgtaccagcaaaagtttcaaccgtgagcaaatcgaccgattttgttgacggttcaaacgtggaaacgaaatagatatccgtcttaaaattcttcatacatctggctaaatgatgacgtcgtagtttgacttcttcatccggtgatttattcgacacttcaatgtcatatttaaatgagttgccaaaaataggtgtctcaggaaagttgattaatctacactccgtcttttgctgttgacgtattaaaaaagaagggaagatatttgcgagatcccaataatcacggtggcggtattcacggggagagcagccgaataactttttaaattcgcggctgaatgactgctgtgaatcaaaatgcaaagagagtgcaatatcaagcatagatttcgcggtgagccggacaagaatggcggcacgacaaagccttcgtttgcgaatgtattctcccaaaggcacatgcatgaaatttcggaacagaagctggatgttgcgtctgctgtagccagatttctgtgcgatatcttcgattgaaatagggtgctcaagattgcactcaatccactccaggagctgctgtagaatcttctgcctgatcatctcattctccgttaattctttgtcatatcgcacattttcgttataccctgggccctaagtgtatcaaaaatagcaagggcgaaggcaaaagcactggtagcgtctgcttcgttgtccccgaaaatagagaggtttcagtcctacattattaatgaattttttgcataagtgatatcaaaatccacatactactttgaggttacgttttaacgtagactcattgttcatgcctaatggagggactgacagtggaattttccgtatagtctgcttcagagtattgcagatgcccatcaaaaatcgatttctcactgacagataaagaaatggcacaaattagttcgcttgatttgggttatgttggggagtcggtaaaacattttaatcctgaatttgttcgtggttgtcttgctgtaaaaatacatgattgatattaatcatgtattttacctaagacgacaaaaaccttttaacagggagtgatattgatcttcactctgtcatatctccggtaatatggcgtcaggcttcatcatcagaaagggggcctgacgcctgaaaaagtgaacaacagacagtgttcggattatcaatattcagtttttaacgttgaactggattcattactgcgttgtttaagaatttcccgcgccgaatctgccattatcatgactgcacctgccagcatcagagtatctttcaataccaggcgaccagcaccggataaataagggaaaccatgatgagcgtcacccaatgcgggtacccatgcctccggggtggtgattaaaaatgagagtgttaccagcggcgtggtaaatgccatcagtcctcccaataaacctaaccagcgattgacaggattagccaaaaccagcagagcaataatcacctccacgacgccaagaccgttggaaaaaccataggtattattggccgtttgccatgcccttgcttctggtttgtattcgccttcgtgagtcagatactgtttatagtcttccgggtgttcataaaagaacgacattagtggactgtttgcgacgaatggtgtaatgctgtctgcctcgtaagggacaaactttaataacccaatccacataaaaacaattgcaatactcagacgaatcaatgtcaggccaattttatctccccgacttaacaggtgcaggtatttttccattgtgaacatccttatttatacaatactgctgttgcggttgaattattatcaattcgcatcgatgtgactttccaggatgaagcattatattttctggctatatcagcaatggtatcctccagaactgtcggtgatgctgatactgacgagacgctgatatgtttcagaattattttatcatctgcattggtggaaaatgccataacgccagataatagtgttgcaaataaaacagattttttaaacatataaaataccatcaatgaagtgattaagaagttatagagtaacagagaattaataagattcttttctctgagacgccagaatatttgttctggcgtctgattttgagtttatttgactaatgaaaatagatcattgagtgattcgctcatcgacggatgagtaaatatctgatcgcgtaatatgctataaggcagcccggcatccatcaccattttcactatattgatcatctcgtgggagtcaacacacagcagtgatgcccctaacatacgttgggttttattatcaacaatcgcttttaataccccacgagtatcattcatcactctggcacgcggaattgcagctacaggcaatgtcaccacctgaatatcagcaccactctctctggcttgttcttctgtcataccaaccctggacaggggcggtgtcataaatacggaataaggcacatttttccgatcatcagtactacgtttgccttcacccagtaactcatcacgtacaatgcggtaatcatccagtgatatgtaagtaaattgcagcccgccggtaacatctcccatcgcccaaatattgtctgcggtggtatgtaatcgcttgtcaacgacaattgccccgcgctcgtttactgcgataccggcattttctggatgtaacgaagcggtagccggttgacgaccggaagctattaacagtgcatccaccgccagttgggcgtgctcgctatgcacttgcacttgattttcatggtgactgattcgctccacatgggcattgaggataatatcgacgccctgatcgcgtaaaatcgtcgcgatattatcagcaatatcccgatcttcccgaggcaaaaacagcgaagctgcttctaaaatggttaccttgctgccaaaattagcgaacatagaggcgaactcaacgccaatatatccgccgcccaaaatacctaaatgcccaggcaattcttttagattaagtaatccggtgctgtcatatactcctggcgtggtggtaattccaggaattggcggaaccacggtttgtgcaccggtattaataaaaattttctcgccatgaatttccagatttccctcaggccgatgaacacgcaggctatgattattgataaactccgcctggccgtcgatcacgtcgatattgggcatatccgcaagattatgaaaattcttattacgtaaaaaattaaccacttcatttttacgctgtatggcacggacaaaatctgtgtgctgctgtgcgtcatgaaccaatgttttggttgggatgcagccgatattaatacaggtcccgccatacattgcatttgattgttcgatgagagccactcgccaacctgcttttgccagcgtgacggctaatgtttttccagccttgccaaaaccaataatcactgcctgatatttattcatgatgatttcctgtcgaaacgcgttcatttgacatcatgactatagacgcaaaagagcaaataacatttcttcacaacgcttgatattttgtcttatcgtctgatattttctttttcttaatcagaatcacaaaacaaaaatcatgattaactatttgatggtattagattagttatttactaagattgttggtgtttgtaatcaaaaaccactcaggagtctgatatggatgcccttagccgtttgttgatgcttaacgctccacaaggaacgatcgataagaattgcgtgttaggaagtgactggcagcttccacatggtgccggggaattatcggttattcgttggcatgcgttaacgcaaggagcggcgaagctggaaatgccgacgggggagatttttacattacgcccgggaaatgtggtcctgctaccacaaaattcagctcatcgcctgagtcatgtcgataatgaatcgacctgtattgtctgcggcactcttcggttgcaacattcggcgcgttattttttaacgtctttgccggaaacgctgtttttagcaccggttaaccacagcgtggaatataactggctgagggaggcgatcccgtttttacaacaggaatccagatcggcaatgccgggagtggatgcactgtgtagccagatctgcgctacattctttaccctcgcggtgcgtgagtggattgcacaggttaatactgagaaaaacattctcagtttgcttctgcatccacgtcttggtgcggtaatacagcaaatgctggaaatgccaggacacgcctggaccgtcgaatcgctggccagcatcgctcacatgtcccgggcaagttttgcccagcttttccgtgatgtttccggaaccacgccgctggctgtattaacaaagttgcgtctacaaatagcggcccagatgttttcccgggaaacgctccctgttgtggtgatcgctgagtcagtaggctatgccagtgaatcatcttttcacaaggcgtttgtccgcgagtttggttgtaccccgggagaatatcgggaaagggtcagacagcttgcaccctgaataaaaccgccagaaatcagggcaaagataatccgcattccgggagttgtgagcctttcaactatttctatttccaacggtggtttgggctttatatattttttctgatggactctagctcagtttttaaataaaaatgcaaactaaattgcttcaattaaataaaatcccgactattacttgatacgtgattattgtcggtgatttttttgtacaccatcagtgtatatctcaataacccctgaataagtagctctgaataggtataagggatgtagccatttttaaatggatttcttatgccaaaaatgatcgtcgatttccccataaaatgtgagcgatgccgaaagaaataaaattagttattgcatttgacgtttggatgaaagattatcatttgtcatacaaatgaggggtggtatgttgctagccaattaaaaaagaacgccatatttattgatgattgatcccccggtgggggggaaacatcgggcataaatgggcatgaagtaatggagtattagttgtgaatgtcaatttctttgtcacctgtattggtgacgccctgaaatcaagaatggcacgagactccgtgctgctactggaaaaactcggctgtcgcgtaaatttcccggagaaacagggatgctgcggtcagcctgcgatcaatagcggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgtgccgcaaaggttgccgcgcgtatgcaggatctcacctcttttattgttaataaattaggggtagtcgatgtaggtgccagtttgcaagggagagcggtgtatcacccatcttgtagcctggcccgtaagctgggagtgaaggacgagccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgcgcacctgatggaagtccgccctgagtatttaattggtgctgacgtgagttgcctgctaaacatcagtgggcgattacaacgggaagggcagaaagtcaaagtgatgcatattgctgaagtgttgatgagccgctgaggatataaagatgtcgatcaaaaccagtaatacagattttaagacacgcatccgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggcggtcacgtctattttgcaagaaccaaagaagacgctacccgctacattttacaggttgcccaacgcaaaaatgcccggaaggtggtgaaatctaaatcgatggtgaccgaagagattggtgtcaatcatgtgttgcaggatgctggcattcaggtgattgaaaccgatctgggtgaatatattctccagctggatcaagatccgccatctcatgttgtggtcccggcaattcataaagatcgccatcagatccgtcgagtgctacacgaacgtctgggctatgaggggccggaaacgcctgaagcgatgaccttattcatccggcaaaaaatccgcgaagatttcctcagtgctgaaataggtattaccggctgtaatttcgcggtggcagagaccggttcggtatgcctggtgaccaatgaaggtaatgcgcgaatgtgtaccacgctgcctaaaacgcatattgcagtgatgggaatggagcgtattgcccccacgtttgccgaggtagatgtattgatcaccatgctggcgcgcagtgccgttggtgcacgtttgacgggatacaacacctggctgacaggaccgcgcgaagctgggcacgttgatggtcctgaagagtttcatctggttattgtcgataacgggcgttctgaggtgctggcctctgaatttcgggatgtgctgcgctgtattcgctgcggggcttgtatgaatacttgtccggcatatcgccatattggcggtcatggatatggctctatttatccagggccaattggtgcggtgatttctccgctacttggcggctataaagattttaaagatttaccctacgcctgctctttatgcacagcttgtgacaacgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagtcgggatgatggccggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataatcgaggcgaatttttgaataacgttgctcaggcactgggtcgcccgctgcgacttgaaccgcaagcagaagatgcgccgcttaacaactatgctaacgagcggcttacccaacttaaccaacagcagcgctgtgacgcgtttattcagtttgccagcgatgttatgttgacgcgctgtgagctgaccagcgaggcgaaggcggcagaagctgcaatacgtctgtgtaaagagctgggagatcagtcggtcgtgattagcggtgacacgaggctggaggaattggggattagcgaacgtttgcagcaggaatgcaatgccgttgtttgggatccggcgaaaggtgccgagaatatctcgcaggcagagcaggctaaagtgggtgttgtgtatgctgaatatggtttaaccgaatcgggaggcgtggttcttttttccgccgccgagcgcgggcgttcattgagcctgctcccggaatattctctttttatcctgcgtaaaagcactatcctgccgcgtgtagcgcaactcgcagaaaaattgcatcagaaagcgcaggccggtgaacgaatgccttcctgcattaacatcattagcggccccagttcaacggcggatattgagcttatcaaagtcgtcggagttcatggcccggtgaaagcggtgtatctgattattgaggattgttgagagagatatgaagtctggacataaacctgaagaaggcatacgaggttgaaaatagcgtttaggacaacctgacttaaccccgttccgtcatggttatgctgctcttctgtaaatatcctggtattaccaatgccaggatatttacagtgaaaaagacaggcatccattcctgaaaacgggttcccttcccggtcattgtcacttcagctttatacaggcactctctatcagaatgttgtttattactgcccagagttttgttggtattcatctaccatttttttgacaaggcaaaacattacagaaattacaatgcttagaaaaaatcccagagccaggcaaatggcagcagggtatttattttttatttctggtgagcttatagttacacagccatcaccgttcggatacaatgaccagttcctggtcaggtatatcatttttgtataaagctcactgttaattgctgaaggcgtttgtatctcatcgagaacttgcctgccattatgatattctgacgcataccatttgataatagaggcctgcacgcgagatatttcctcttcagcagttggtaaagctctcttatctcctgaccattccagccttatttctctgttcttgacatctgggctggtgtgaaaaaatgtagtaattcgctgaataacatcttcagtcattgtagtctgacaggcaaaattattattgctatcacagctaacaagtatacctggcgttgtctggtttatttttaggctgtaaatcacttttatattgtctttattgatatacagaaacaacagcaccatagccatacatatagccataataaaaaggataacacgaatctttttcttcagataaaataaaatctcaatcagatcgatatcctgtttgatttgttcacgcataatatatccagagaataaaatctgtcgcagataaggttgtattaatagtctgtatcaggaatgttcgggttaaatatcagcaaaaagcccgcatcatgaatactggatatgaagcatgagagttacctcagtgtttatataaggattcggtccccctctctggaacggtaactctcaatctgatcggttcctgcgttagttcacatcacgactcattttttcgctctcaccggcatcccatttgccacaaaatatcccgccgtgctcctcggcagcgcttcctgtccacgaatcatatccgctattttctcgccaatcataattgtcgtggcgttcaaattcccggtgataatctgcggcataatcgacgcatccaccacacgcaggccttctaacccgtgtacgcggccttcgccgtcaaccacggacatctcgtcgtaacccattttgcaggtaccgcacggatggaaggcggtttcggcgtggttacgcacgaactcatcgagctgttcatccgtctggcattcgacaccggggctgatttcgcggccacgatactgatccagcgcgggttgatgcatgatctcgcgggtgatgcgaattgcgtcgcggaactcctgccagtcctgctcgtgcgacatgtagttaaacagaatcgccggatgctggtgcgggtcgcgggatttaatccgcacatgcccacggcttggcgagcgcattgagccgacgtggcactggaaaccgtgctctttcactgcattcgagccgttatagttaatcgctactggcaggaaatggtactgaatattcggccacgcaaattcctcacggctgcgaataaatccacctgcttcaaagtggttgctggcaccaacgccagtgccgccaaacagccactccgcaccgattttcggctggttccaccactgcagggcagggtagagggaaaccggttctttgcactcatattgcagatacatctccagatgatcctgaagattttcgccgacgccgggtaattcatgcaccagcggaatatcaaactccgccagcagttcagcgttgccgacgccggagcgttgcaggatctgcggtgaggcaatcgcgcctgcacataacagcacttctttgttggccgttgcgcgggttgggatggtgctgtcgccttccagccattcgacgcccaccgcgcgtttgccgtcaaaaatgatgtgatcggtcatagcgtgagtacgaatggtcaggttaggacgcgatttggcctgatcgagatagccacgcgcggtgctggcgcgacggccctgcggcgtgacggtgcgatccatcggaccaaaaccttcctgctgataaccgttgagatcgtccgtgcgcgggtagcccgcctgcacgcccgcttcaatcatcgcttcaaacagcggattgacgccgggtttggaggtagtgacgctcaccgggccatcaccgccgtgatagtcgttttcacccatatcgcgagtctcggccttgcggtagtagggcaggcagtcgaggtagctccagttctccagaccgggttcttgcgcccagttatcgagatccagcgcattgccacggatgtagcacatgccgttgatcagcgacgatccacccagacctttaccgcgtccgcactccatgcggcggttattcataaacggttcaggttccgtttcataggcccagttgtagcgtttaccctgtagcgggaatgccagggcagcgggcatctgggtgcggaagtcaaagcgatagtccgggccgcccgcttcaagcagcagcacggaggtattcggatcttcagtcagacgggtagcgagaacgttgccggctgagccggcaccaataatgatgtagtcaaattgcaaataaacctcctggttagaatatggactggaatttagccatctcaacctggatggacttcacctgggtgtaactctggagcgtcatcacgccgttctcgcgaccaatgccggagtgtttgtagccgccaacgggcatctctgccggggattcgccccaggtgttgatccagcaaatacccgcttccagctgatgaatgacgcgatgcgcgcggttcaggtccgctgtcacgatgcccgccgccaggccgtagtcggtatcgttagcgcggcgaatgacttcgtcttccgactcgtaggtcagaatggacatcactggcccgaagatctcttcacgcacgatggtcatatcgtcgctgcaatcggtgaacactgtcggtgcaacccatgcgccgttatcgaagccatcgcctttcagtacatcgccgccgcacagtacgcgcgcgccttcctctttgcctttggcgatatagcgcagcacgttatcgcgatgcgggaagctgaccagcgggccgaagttagtttgcggatcgaaaacgtcgcccgcgcgaatgcgctcaacgcgcgccagaattttctgctcaaatgcggctttgcatttcgccggaacgaagacgcgggtgccattggtacacacctgaccggagctgaagaagtttgccatcatggcgatatcggcggcgagatcgagatccgcatcatcgaaaacgatcagcggtgatttaccgcccagttccatggtcacttctttcagggaagaggccgccgagttagccatcacttttttgccgctggcgacaccgccggtaaatgacactttggcaatgcccggatgctcggtcagatattgcccggtctccgcgcccacgcccggcaacacgttaaatacgccgtccggcaggcccgcttcgctgtaaatttcagccagctttaacgcggtaagcggggtaacttcgctcggtttgaaaatcattgcgttgcctgccgccagcgccggggcggatttccacagggcaatctggatcgggtagttccatgcgccaatccctgccactacgcccagcggttcgcggcgggtatacacaaaggacgtttcacgcaacgggatctggctgccttccagcgccgggatcagcccggcgtagtactccagcacgtccgcaccggtaacgatatcgacggttgaggtttccgaatatgcttttccggtgtcgagggtttccagttttgcgagttcgtcattgcgttcacgcagaatatcaacggcccgacgcagaatacgcgagcgctccatggcggtcatcgacgcccagattttttgcccctgctgggcgcttttcacggcgcgatcgacatcctcgcgcccggcggcctgcacggtcgccagcacgttaccgttggccgggttaatggtctcgaaggtgcgaccgctggtggcggaggtataaccaccatgtatataaagctgctgttctgccattcgggacatcacgtctcctcggttaatcggtgggtagatgctgagtgataaagtggcgggtcagggaattagcgcgggttttatccagcggtttgccgctcagagccgcgcgcagccataatccatcaatcagcgcggccaggccgtagcccgcttcctgtgcctgttcgcgcggcaattcgcgacgaaactcgctcaccagattcgacagcaagcggcggctgctgacctgctgtaaacgatagagcatcggctgatgcatactgctggcccagaacgccagccaggctttcatcgccgcactgctcacctgcgtttcatcgaagtttccgccaacaatcgcctgtaatcgctgctctgcactgccctgcggaagtgcatgtaatcgattcaaaaccgcgtcacgcagctgactggtgatatcgcgcatggttgcttccagcagaccatttttgtccctgaaatagtggctgatgatccccgtagaaacgcctgcacggcgggcgatctgcgcgatcgttgcatcgtgcatgcccacttcatttattgcttccagtgtggcgtcgatcagttgtctgcgccggatcgactgcatccccaatttgggcattttcgccactccattcatcagcggtgtttatctattaaagcggttattgattggacgttcaatataaaatgtgtcttaattgttacgaatttgattttaaatagtaacaataacagtggggatactggatgacagacctttcacacagcagggaaaaggacaaaatcaatccggtggtgttttacacctccgccggactgattttgttgttttccctgacaacgatcctgtttcgcgacttctcggccctgtggattggccgcacgctggactgggtttctaaaaccttcggttggtactatctgctggcggcaacgctctatattgtctttgtggtctgtatcgcttgttcgcgttttggttcggtgaagctcgggccagaacaatccaaaccggaattcagcctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcaccatccgctcggcgctgtacccgatcttcggtaaacggattaacgggccgataggtcactcagtggatattgcagcggtgatcggcactatcttcggtattgccactacgctcggtatcggtgtggtgcagcttaactatggcttgagcgtactgtttgatattcccgattcgatggcggcgaaagcggcactgatcgccttgtcggtgataatcgccacgatctctgtcacctccggtgtcgataagggcattcgcgtgttatcggagcttaatgtcgcgctggcgctgggattgatcctgttcgtattgtttatgggcgacacttcgttcctgcttaatgcactggtgctgaatgttggcgactatgtgaatcgctttatgggcatgacgctcaacagttttgccttcgaccgtccggttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtgttcggcaatagcgcgctgtatgaaatcatccacggcggcgcggcatttgccgaggaagcgatggtccatccggagcgcggcttctacagcctgctggcgcagtatccggcgtttacctttagcgcctccgtcgccaccattactggcctgctgttttatgtgacctcggcggactccggggcgctggtgctggggaatttcacctcgcagcttaaagatatcaacagcgacgcccccggctggctgcgcgtcttctggtcggtggcgattggcctgctgacgctcggcatgctgatgactaacgggatatccgcgctgcaaaacaccacggtgattatggggctgccgttcagctttgtgatcttcttcgtgatggcggggttgtataaatctctgaaggtagaagattaccgccgtgaaagtgccaaccgcgataccgcaccgcgaccgctggggcttcaggatcgcctgagctggaaaaaacgtctctcgcgcctgatgaattatccgggcacgcgttacactaaacagatgatggagacggtctgttacccggcaatggaagaagtggcgcaggagttgcggttgcgcggcgcgtacgtggagctaaaaagcctgccaccggaagagggacagcagttgggtcatctggatttgttggtgcatatgggcgaagagcaaaactttgtctatcagatttggccgcagcaatattcggtgccgggctttacctaccgcgcacgcagcggtaaatcgacctactaccggctggaaaccttcctgttagaaggcagccagggcaacgacctgatggactacagcaaagagcaggtgatcaccgatattcttgaccagtacgagcggcaccttaactttattcatctccatcgtgaagcgccgggccatagcgtgatgttcccggacgcgtgattgttattgcataaaaccgcgccatgtctgcatatggcgctgtttctcctacctcttgatacgttatatctatacggttaagcccttagtatctattgatgattaccagacaacagataataaaaaagaaaagaactattgcagcccaaaacctacatttgggctgttgcgaatgttcaataagtttagtcttatttaatgtaaatattgctgatcatttgaaatgacgcattattcatgagaaatgtgtatcgtaaatcaactgaaattaacgcaaccatttgttatttaaggtttaattatctgtgtgtgatattttattgaatgttttaaatattgtttttattggcattgctataatattggttatcatttgctgaatggattcagtcttaatgagtgggtttttaagggacaggcatagagtaatgatacgtatgcataaccaacatctttactcattatgtcattgaatgttgacgctatgtgtttatgagggagaggtattttcagttgatctggattgttaaattcatataatgcgcctttgctcatgaatggatgccagtatgtagtgggaaattataaatattgaaatagtccaactacttctttattaccaaaaatgagtatctgaattttaatattgcattcttgcgtgattatctcctgagtttgacttgtgattacctttttaaggtatttagcgtaactgtttttgagcgagcatcagaggtaaagataatcttcttgatagtgatgtgggatgttatacgtatggcatcgctgatgtttatggttaccccttatgtgtgctcaggaatcgacaggtaatcactcatactgaacagcgataaaagataaaggtgtgttcatgaattcatgtgattttcgtgtttttctgcaagagttcggtacaacggttcatttgtcattgcctggtagcgtatccgagaaagaacgactgctactcaagctgctgatgcagggaatgtctgtaacagaaatatcacagtacagaaatcgcagtgcaaagacaatttcacatcaaaagaaacagctctttgagaaactggggattcagagcgatattactttctggcgcgatattttctttcagtacaatccggagatcatatccgccacggggagtaatagtcacagatatattaatgataatcactatcaccatatcgtcacgcctgaagccatcagtctggcgttggaaaaccacgaattcaaaccgtggatccaaccggttttctgcgcgcagactggcgtactgacgggctgtgaggtgcttgtccgctgggaacatccacaaacgggaattatcccaccggatcagtttattcctctggcggagtcatccggtcttattgtcataatgacccgccaactgatgaaacagactgcggatattctgatgccggtaaaacatttgctgccggacaatttccatattggcatcaacgtctcggcgggttgttttttggcagcgggatttgaaaaagagtgtctgaacctggttaataaattaggtaacgataaaatcaagctggttctcgagctaacggaacgtaaccctattccggtaacgccagaagccagagcgatatttgacagccttcatcagcacaacattacctttgcgctggatgactttggtacgggttatgcgacctatcgttacttgcaggcgttcccggtcgattttattaagatcgataagtcatttgtgcaaatggcgagtgtcgacgaaatctccggtcatattgtggacaatattgtcgaactagcgcgtaagcctggtctgagtatcgtggcggaaggggtagaaacccaggagcaggcggatttaatgatcggtaaaggcgttcactttttgcagggctatttgtactctccgccagtaccgggtaataaatttatctctgaatgggtaatgaaagcaggtggttgatgtaaaccgctattcacagcgcatcgggaggttggcagcgattaattctcccgatgcagtaaatcctgatagatccccgttaatatgccatttggcgcaaattgttttttaatccactgcgtcacctgacccgtagcagaatgctgagtcgccagtaacatgcgcgaatcctggcgcggattatggatttgtcgggtaaccagcagggattgcgtcatcgcctcacggaccatgtaatccggcaaaaaaccaattccttcacctaaaatctggcactgacatttggtgttgaaatctggcaccagaattgactcctgcccgtgcagcaaccagcccacttttttattaatcgtatgcgcggtgtcctccaccataatattagggtagagacgcagttggctttcggcgatgggttccggcacaaaggctaacgggtgatccggggcgatagcaaaagcccagcgaatcgcgccaatttcagtgtaatcaataccgccgccgtccagtagtgtatcgggtgcgccgatggcgatattggcctgattattaataatcgcatcccagacgccgttatacacttcggtggtgacggtaatctggcaggtaggaaactgctttttcagcacctgtaacaagcgtgcggtgtgtttgggcgtataaagcagctgattaatacaaatgcgcacacgcgcttctatgccctgcgaaatagtatcgattctgcgtttgatggcataaaaatcattcagcaggtcggtagctttgcggaaaaaataacgcccggactccgttaactcaatgctgcgggtactgcgagtgaacagcaccacatccagccccgtctccatacgcttaatggtgtagctaatggcggaagtggttaaacccaactcttctgcggctttactgaagctgccaaaacgcgcagcggtagtaaatgccaacagattctcttcggtaaaaattgagttcattaaaccattctcgccattatctactatgaatttctccagctatgactgtagaggtatcggttaaagatagataatcatttttgaataacttttaatacccgtcgcgtttagtcgtcgcttcgcttaatttttgtccaccatattctgaaattacccccacgcagttacccgccagaaaacccagtaacgtcaccgtccagttcatcccgctggcaaaaaacagcgtcatgccgagaaagccaccgggaataaaggacagtaaccagaaacgcccttgccagaccactaccgccgagaagggtacggtagtaattacgctcgcccagaacgcggacagtccacttacagaggccagccaaccagcagtcagcgcggcgaaaaacgcccacaccatcccggaataattaaccgccagacttctgataaaccccgatttaccgccgcctgcggcataaaaactgcaaaaggcgacgaagccaatggttcctaataattcccatccttgagagagcccgacatgtgaagacactaactgccaaagccctgcacaaataccgacggtgacacccgttgccgtgagtccgttcatcttgttcccctctggttagacatggacgaaagctactcttacatgtgcagactatagagaaataaaacctgattgagtgaaagggtatcgggtcaaagaaacaaatattgcactaccgcacactgcgaaaagattgttgaatattattcaacaaaaaggcgagatacggcgaattaaatttaagcgggttcttttatcagattatcgttgctattctcaattcatcgaaaacagccacaaaaaccaggggaatgtgaatgagtataaaaaatctacctgccgactatttattggctgcacaacagggtgatatcgataaagtaaaaacctgccttgcgctgggtgtcgatattaatacctgcgatcgtcaggggaaaacggcaattacgctggcaagtttatatcagcaatatgcttgcgttcaggcattaattgatgccggagcggatattaataagcaagatcatacctgtttaaatccttttttaattagctgtctgaacgatgatttaacgctactacgaattattttaccggctaaacccgatcttaattgcgtaacccgttttggcggtgtcggcctgacgcctgcctgtgaaaaaggccatttaagtattgtaaaagagcttttggcgcatacggagattaacgttaaccagaccaaccatgtaggctggacgccgctactggaagcgattgtgcttaatgatggtggtattaaacagcaggcgattgtgcagttattgctggaacacggtgccagcccgcatctgaccgataaatatggcaaaacgccactggaactggcgcgggaacggggctttgaagagattgcgcagttactgattgccgcaggtgcataaaccgggaggcttgctatcaacacaccagaaagacggtgtgtgtgggcgctaactgcggatgcggattttctggcgcagcgggggcaaggacaggttgaacaggtctttgccagagcggtaaatatcgcactcccggctcgccagcagttgctgacgctgctttgtgaagagtacgacaatgcgccaaacagttgtcggttggcactcactcactttgatgatctgttccggcatggtgataaggttcagtttgacgatcaaggtattacggttggtcaacatcttcatatagagatgagtcgttgtcggcgttggctgtccccaaccttgcaaatgaccgctgtgaattttcaccttatcgcctggctacagtggcacgacattattcatcagcacctgggggaaaatgaaaccctgtttaattatcgcggcgataatccgttttatcaggcgttaaataaagaattacatattaaacgacgggcagttattcaggccgtaaacgataaacaaaatatcgcctcagcggtcgccagtatgatggggttagggattggccttacgccatcagccgacgattatttaacaggtctggcgcttattttatttattcccgggcatccggcggaaaaatacaaagaggaattttatctcggtctgcaacgcggcaaaaataataccacattattaagtgccataacgctggaagccgcattacaacaacgctgccgggaaaatattcatcgttttattcacaacattatttatgacatccctgggaacgcaactcaggcaatagaaaaaattaaacatattggctccagttccggctgcgacatgctgtatggcatggccgatggttgtgcgctgagccaaacctacggagggaattatgtcagttaaaatagtcattaaaccgaatacctattttgattctgtctcgctgatgtctatctccacgcgtgcaaataaactcgacggcgtcgagcaggcatttgtggcgatggcgaccgaaatgaataaaggcgtgctgaagaatttaggactgctgacgccggagctggagcaggcgaaaaacggcgacctgatgattgtcatcaatggtaaatcgggtgcggacaacgagcagttactggtggagattgaagaactgttcaacaccaaagcgcaaagcggctcgcacgaggcgcgttacgccactattggcagcgccaaaaagcatatcccggaaagtaacctggcggtgatttcggtcaacggtctgtttgccgctcgcgaagcgcgtcaggcgctgcaaaacgatctcaacgtgatgctgttttccgataacgtctcagttgaagatgaactggcgctcaagcaactggcccacgaaaaagggctgctgatgatggggccagactgtggcacggcgattatcaacggcgcggcgctctgttttggtaacgccgtgcgtcgcggcaacatcggtattgttggcgcatccggcaccggcagtcaggagttgagcgtccgcattcatgaatttggcggcggcgtttcgcaactgattggcaccggcgggcgcgacctgagcgagaaaatcggcggcctgatgatgctcgacgccatcgggatgctggaaaacgatccgcaaactgaaatcattgcgcttatctccaaaccgcctgcgcctgcggtggcccgcaaagtgctggaacgtgcgcgcgcctgccgcaagccggtggtcgtctgcttcctcgatcgtggcgaaacgccagtggatgagcaggggctacagtttgcccgcggcaccaaagaggcagcgctaaaagcggtgatgctctccggcgtgaaacaggaaaatctcgacctgcatacgcttaaccagccgttgattgcggatgtgcgtgcgcgtctgcaaccgcagcagaaatacattcgtggcctgttctgcggcggcacgctgtgcgacgaaaccatgttcgcggtgatggaaaaacatggcgatgtctacagcaacattcagcccgatccggaattccgcctgaaagatatcaaccgcagcatcaaacacaccttcctcgactttggcgatgacgacttcaccaatggcaagccgcacccgatgattgaccccaccaaccgcatcagtcgcttgatcgaagaggcgcgcgatccagaagtggcggtgatcgtgatggattttgtgctcggatttggatcgcatgaagatccggtcggctccaccatcgagacgatcaaagaagcgaaagcgatcgccgctgccgaaggacgcgagttgatcattctcgcctatgtgctgggtaccgatcttgatacgccatcgttagaacaacaaagccagatgctgcttgatgccggagtgattctggcgagcagcagcaccaataccggattgctggcgcgtgaatttatctgcaaaggggaggaagcctgatgagccagtcactgtttagccaaccattgaacgttattaacgtcggcatcgccatgtttagcgatgacctgaaaaagcagcatgtagaagtgactcaactcgactggacgccgccggggcagggcaatatgcaggtggtgcaggcgctggataacattgccgattcgccgctggcggacaaaatcgccgccgctaaccagcaggcgctggagcgtattatccagtcgcatccggtgctgattggttttgatcaggcgattaacgtggtgccgggcatgacggcgaaaaccattcttcacgccgggccgccgatcacctgggaaaaaatgtgcggcgcgatgaaaggcgcggtcaccggagcgctggtgttcgaaggactggcgaaagatctcgacgaggcggctgaactggcggcttccggggagatcaccttctcgccgtgtcacgagcacgactgcgtgggatcgatggcgggtgttacctcggcctcgatgtttatgcacatcgtaaaaaacaaaacctacggcaacatcgcttataccaacatgagcgagcagatggcgaagattttgcgtatgggcgctaacgaccagagcgtgattgaccgcctgaactggatgcgtgatgtgcagggaccaatactgcgcgacgcgatgaaaattatcggcgaaatcgatctgcgcttaatgctggcgcaggcgctgcatatgggcgatgagtgccataaccgcaataacgccgggacgacactgctgattcaggcgctgacgccggggattattcaggcgggttattccgtcgagcaacagcgcgaagtgtttgagtttgtcgccagcagcgactacttctccggcccgacgtggatggcgatgtgtaaagcggcgatggatgcggcgcatggcatcgaatacagcaccgtggtcaccaccatggcgcgtaacggcgtcgagttcggcctgcgggtcagcggcctgccggggcaatggtttaccggcccggcgcagcaggtgatcggcccgatgtttgccggttataagccggaagattcggggctggatatcggcgacagcgccatcaccgaaacctacggtattggcggatttgctatggcgaccgcgcccgctatcgtcgcgctggtgggcggcacggtggaagaagctattgatttctcccgtcagatgcgcgaaatcaccctcggtgaaaaccccaacgtcaccattccgctgctcggttttatgggcgtgccgtcggcaatcgacatcacccgcgtgggtagcagcggcattctgccggtgatcaacaccgccatcgcccataaagatgcgggcgtcggcatgattggcgcgggcattgtgcatccaccttttgcctgcttcgagaaagccattcttggctggtgcgaacgttacggcgtctgacctacatgttcatgccggatgcggcgtgaacgccttatccggcctacgaatggcgcaagaatctgtaggcctgataagcgtagcgcatcaggcatttgtcaccattgccggatgcggcgtgaacgccttatccggcctacgaatggcgcaagaatctgtaggcctgataagcgtagcgcatcaggcatttgccaccactgccggatgcggcgtggacgccttatccggcctacgagtggcgcgagaatctgtaggcctgataagcgtagcgcatcaggcatttgtcaccattgccggatgcggcgtgaacgccttatccggcctacgagtggcgcgagaattgtaggcctgataagcgtagcgcatcaggcagtctggcgttggtcataaccccatcaccctctgtagcggacataacaacatgaaagagcttgtggtcgttgccattggtggcaacagcattatcaaagataacgccagccagtcgattgagcatcaggcggaggcggtgaaagccgtcgccgatacggtgctggaaatgctggcttccgattacgacattgtgctgacccacggcaacgggccgcaggtcgggctggatttacgccgtgcggagattgcccacaagcgcgaagggctgcccttaacgccgctggcgaactgtgtggcagatacgcagggcggcatcggctatctgatccaacaggcgctgaataaccggctggcgcgtcacggcgagaagaaagccgtcaccgtggtgactcaggtggaagtggataaaaacgatccaggttttgcccatcccaccaagcccatcggcgcattctttagtgacagccagcgtgacgaattacaaaaggcaaaccctgactggtgttttgttgaagatgccgggcggggctatcgccgcgtggtcgcctcgccggaaccgaaacgtattgtcgaagcacctgccattaaagcgctgatccaacaaggttttgtcgtaattggcgcgggcggcggtggaattccggtagtgcgtactgacgcgggagattaccaaagcgtggacgcggttatcgacaaagatctctctaccgcgctgctggcccgtgaaattcacgccgacattcttgtgatcaccactggcgtcgaaaaagtgtgtattcactttggcaaaccgcagcagcaggcgctcgatcgggtggatattgccaccatgacccgctatatgcaggaagggcatttcccgcccggcagcatgttgccaaaaatcatcgccagcctgacatttttagaacaaggcggcaaagaagtgattatcaccacgccggaatgcctgcctgcggcgctgcgcggcgaaacgggcactcatattattaaaacgtaaggacgtaagatgaaagaaagcaatagccgccgtgaatttctgagccagagcggtaagatggtcaccgccgccgcgctgtttggtacctctgtgccgctcgcccatgcggcggtagctggcaccctaaactgcgaagcgaacaacaccatgaaaatcactgacccgcattactatctcgataacgtgctgctggaaaccggttttgactacgaaaatggcgtggcggtgcagacccgcacggcgcgccagaccgtggagattcaggacggcaaaattgtcgccctgcgcgagaacaagctgcatccggacgccacgctgccgcactatgacgctggcggtaagctgatgctgcccaccacccgcgacatgcatattcatctcgacaaaaccttttacggcgggccgtggcgctcgctcaatcgtccggcaggcaccaccatccaggacatgatcaaactcgagcagaaaatgctgccggaactgcaaccgtacactcaggagcgggcagaaaaactgattgatttattgcagtcgaaaggcaccaccattgcccgcagccactgcaatatcgaaccggtttccggcctgaaaaatctgcaaaatttgcaggcggtgctggcgcgacgtcaggcgggctttgagtgtgaaatcgtcgccttcccgcagcacggtttgctgctgtcgaaatctgaacctttaatgcgtgaagcgatgcaggcgggggcgcattacgtcggcggcctggacccgaccagtgttgatggcgcgatggaaaaatccctcgacaccatgttccagattgcgctggactacgacaaaggcgtcgatattcacctgcacgaaaccactccggcaggcgtggcagccatcaattatatggttgaaacggtagagaaaacgccacagctgaagggcaagctgaccatcagtcacgcctttgcgctggcaacgctcaacgagcaacaggtagatgaactggcgaaccggatggtggtgcaacaaatttctatcgcctcgacggtgccgattggcacgctgcatatgccgctcaaacagttgcacgacaaaggcgtaaaagtgatgactggcactgacagcgttatcgaccactggtcgccttatggtctgggcgacatgctggaaaaagccaatctgtacgcgcagctctatattcgtcctaacgaacagaacctctcccgctcgctgtttttagccactggcgatgtattgccgctgaatgaaaaaggcgagcgtgtatggccaaaagcgcaggatgacgccagctttgtgctggtggacgcctcctgttccgccgaggcggtggcgcgtatctcgccgagaaccgcaacgttccataaagggcaactggtgtgggggagtgtggcaggttgatgcgcatttgaaacgcctgcaacggtgaatagtaagagatttaagccccagggagtggggcaatctgaatatgagtgtgtcggcagaaatggacattatctttgaggaatatgcccttattgacgttgtgtagataactatttgtctacgtgaaaagatcatcagttttgccgattttagtcttttacagatagcaaatatcacacttacaggcgctcgccttatggggaacgttgctgctctgtttcattcaggctcgcggcatgttggggctggatcgggtggtttaaatattggctatattcaatggacgcgttttgccgcgatgacatatcaggcgttgccaaatacacatagctaatcaggagtaaacacaatgaagatcaaagctgttggtgcatattccgctaaacaaccacttgaaccgatggatatcacccggcgtgaaccgggaccgaatgatgtcaaaatcgaaatcgcttactgtggcgtttgccattccgatctccaccaggtccgttccgagtgggcggggacggtttacccctgcgtgccgggtcatgaaattgtggggcgtgtggtagccgttggtgatcaggtagaaaaatatgcgccgggcgatctggtcggtgtcggctgcattgtcgacagttgtaaacattgcgaagagtgtgaagacgggttggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggattaagctggcccacgcgatgggggcacatgtggtggcatttaccacttctgaggcaaaacgcgaagcggcaaaagccctgggggccgatgaagttgttaactcacgcaatgccgatgagatggcggctcatctgaagagtttcgatttcattttgaatacagtagctgcgccacataatctcgacgattttaccaccttgctgaagcgtgatggcaccatgacgctggttggtgcgcctgcgacaccgcataaatcgccggaagttttcaacctgatcatgaaacgccgtgcgatagccggttctatgattggcggcattccagaaactcaggagatgctcgatttttgcgccgaacatggcatcgtggctgatatagagatgattcgggccgatcaaattaatgaagcctatgagcgaatgctgcgcggtgatgtgaaatatcgttttgttatcgataatcgcacactaacagactgaaaaaattaataaataccctgtggtttaacatattaacttcgctctccacttaactttttagttaaggagagcgaaataatatcaaagtagcagtaaaacctataacgtaaatttaaattgttaaattaacgccctccagtacacaatacttcacacgttagttatgagcgatttctgatagtgcctggtttaatcagagctttattatctgcgacgtttatttttatttaagagagatcgcgatgatatcattaaaagctccgcacaataatttgatgccatatacgcaacaaagcatacttaatacggttaaaaacaatcagttaccagaggatatcaaaagctccctggtttcctgtgtcgatatattcaaggttttgattaaacaatattatgattatccttatgattgtcgtgatgatttagtcgatgacgacaaactcattcatctcatggctgccgtacgagactgtgagtggtcagacgataacgcactcaccataaatgtgcagtttaatgatttccctggattttatgactggatggattaccctgatcacccggttaagtttgtttttcacatacttgaaaatcaaaaagggacagtttgggtatatgaccaggatgatgcgtttcttgatattaaagcaaacgtgcaggctggacgctttaccgggcttaagaaattagtgcagtttatcgattcagtgcgaacagattgcaaatgtattcttcttgaataccatatgcctttgctgagaattttccctaaagggaaagagtgtatgcatgtggaaaaatggcttcgcgaaatgtcgtctattccggagacagacgcgcccattaagcaggcgcttgcgcatggattattattacacttaaaaaatatctaccctgtttttcctgaatcactggtgatgttattgctctctgttctggacgtaaaaacatacagagatgatgcgcgattaaatgaatggatatctaatagagtgcaggaattaggtgacagatattatcctgtaaataagcacgttaaaatccgctacactctttagttcagaaagggttccacctgcaagttgttattccacctgagagtgaatcgcaatgcaggtaatcatttcatctgtatatctgtatgccaactggcattccatctcttttttcgccgatattttgttgtgatcggcgacacttcgcttaaaaaagcaccagtagtggtttcgcagccatgcggtgtataaaaaatgatctcatgcagatgttttgtgaatgtgttggttgacattcatatgaaaaaaatcataattccatcatgtttgtgtggggtcttttctgtatcttacgcatcgcactcaagcctgacagaaaatatgctgtaaggctcatatcaaaaaccgccattagctcatcaggaagagcagacgacaaccaggattgttgtatggtacggggttcgaggcctcgatggcggtccaacttttcaaaactcttctgaatcagatccccttattatcatccctgcaaagtggaacattgccattgtttggctattcaggatggggcagaccaatgaaaaaagcccacacaggggagagtgggctgaaatgggaagctaaagactcaagtaaacttatcggaaataaggaccacgcattacgggggctatcatcgccgatggccgtgattcggcaaatcaggttgattacgtagagagtaaattatctgctcaccgctgcgtcaccccttcgtaaatcaggcgtagcgcgaatacaccaataattgcaccaataacccgactggcaacgcgttgcatacgcccataagcacgacgcacagcgggcaaagaaaacgcctgactaagaaaaactcgccagataattgatgcgagcacaatccccgcccaggccattaaacgtgcccatgttggtgtttcggcatttaatgttactgagaaaatactgataaaaaataaaacggtttgcgggttagagagatcggtaattaatccgcggcgaaaaaagacataccagggggcgctaatcggttgttgtagtgtgctcatttgcggtgttgactggcggcgcatgctgcaccacgcaaaccataagagataagcgccgccgacgattctgataagcgaaaaaatctcctcacactgcgtaattagcgttgcaagaccaaacaaacccaacccggaataaaatgcatcgcccagcgccacgcccagcccggtcagcacccctgcgcgtcgaccggaagccaggctggtttgtactaccacaaagagattggctcccggattaaaaaaagtaatcacgaacagtcctacggtcaggtaaacggcatgcaaaggatccatagtgatttcatccataaataagtgaactaactgcatcatatttctaccaaaaataatcgggtgcgagagagatcacaaagtgtcttatttccggttactggcgtttatgccctgactgaactaattattaatcaacccaataatgtgggtgggtgatagtgtgataacaactctggagccgtaatatgaaaataatctctaaaatgttagtcggtgcgttagcgttagccgttaccaatgtctatgccgctgaattgatgaccaaagcggaatttgaaaaagttgaatcgcagtatgaaaaaataggtgatatttcaaccagcaatgaaatgtcgactgcagatgcaaaagaagatttgatcaaaaaagcggatgaaaaaggggctgatgtgttggtactgacctccggtcaaactgacaataagatccacggcacggcaaatatttataagaagaagtaattctgaatcctatgtaaacatctccgatgcgtaagtttatcggtgatcatctattgaaatttatgccggataaagcgttcgcgctgcattcggcagttcagcttttcagccgccgccagaacgtcgtccggctgatgcctaaataattcgccgctgctgttttatcgccattaaatttctccagtgcctgttgtggtgtcagtaagcgtggagcgggagttttcgccgactcgcgcgccagttccggcagtagcagttgcataaactgcggcgttaaatccggcgtcggttccacacttaaaaacagcgccagtcgttccatcatattgcgcagttcacgaatattgcctggccagtcgtagtgcagcagcacagtttcacttgcctgtaacccctggcgtaatgcagcagaaaatggggcggagagcgccgccagagacactttcaaaaagctttccgccagcggaagaatatccgccacccgctcgcgcagtggtggcaattgcagacgcaaaatactcagccgataaaacagatcacggcgaaaacgtccttgctgcatatcttcttccagattgcagtgagtggcgctaatgacccgtacatctaccggaacaggctgatgcccgccgacgcgggtgacctctttttcttccagcacccgcagcagccgggtctgcaaaggtagcggcatttcgccaatctcatccagaaacagcgtaccgccgtgggcaatttcgaacagcccggcgcgacctccgcgtcgcgagccggtaaacgccccttcctcatagccaaacagttctgcttccagcagcgattcggcaatcgccccgcagttgacggcaacaaacggatgcgactttttgccctgtcgcgcatcgtggcgggcaaaatattcccgatgaatcgcctgggccgccagctctttgcccgtccccgtttccccctcaatcaacaccgccgcactggagcgggcatacagcaaaatagtctgccgtacttgttccatctgtggtgattgaccgagcatatcgcccagcacgtaacgagtacgcagggcgttgcgggtggcatcgtgagtgttatggcgtaacgacatgcgcgtcatatccagcgcatcgctgaacgcctggcgcacggtggcggcggaatagataaaaattccggtcattccggcttcttctgccaaatcggtaatcagccctgcgccgaccaccgcttcggtgccgttagcttttagctcgttaatctgcccgcgtgcgtcttcctcggtaatgtagctacgttggtcgaggcgcaaattaaaggttttttgaaacgccaccagcgctggaatggtttcctgataggtgacaacgccgatagaagaggtgagttttccggcttttgccagtgcctgtaacacatcgtagccgctcggtttaatcaaaataactggcactgacaggcggcttttcaggtacgcgccgttagagccagccgcgatgatggcgtcacagcgttcgtttgccagtttcttgcggatgtaggtcactgctttttcaaagccaagctgaataggggtaatgttcgccaggtgatcaaactcgaggctgatatcgcgaaacagctcgaacaggcgcgttacagataccgtccagataaccggtttgtcgtcattaagccgtggtggatgtgccatagcgcaccgcaaagttaagaaaccgaatattgggtttagtcttgtttcataattgttgcaatgaaacgcggtgaaacattgcctgaaacgttaactgaaacgcatatttgcggattagttcatgactttatctctaacaaattgaaattaaacatttaattttattaaggcaattgtggcacaccccttgctttgtctttatcaacgcaaataacaagttgataacaaaggatgggctatgtctctacactctccaggtaaagcgtttcgcgctgcactgactaaagaaaatccattgcagattgttggcaccatcaacgctaatcatgcgctgttggcgcagcgtgccggatatcaggcaatttatctttctggcggtggcgtggcggcaggttcgctggggctgcccgatctcggtatttctacccttgatgatgtgctgaccgacattcgccgtatcaccgacgtttgttcgctgccgctgctggtggatgcggatatcggttttggttcttcggcctttaacgtggcgcgcaccgtgaaatcgatgattaaagccggtgcggcaggattgcatattgaagatcaggttggtgcgaaacgctgcggtcatcgtccgaataaagcgatcgtctcgaaagaagagatggtggatcggatccgcgcggcggtggatgcgaaaaccgatcctgattttgtgatcatggcgcgcaccgatgctctggcggtagaggggctggatgcggcgatcgagcgtgcgcaggcctatgttgaagcgggtgccgagatgttgttcccggaggcgattaccgaactcgccatgtaccgccagtttgccgatgcggtgcaggtgccgatcctcgccaacatcaccgaatttggtgccacgccgctgtttaccaccgacgaattacgcagcgcccatgtcgcaatggcgctgtacccactttcagcgttccgcgccatgaaccgcgccgctgaacatgtctacaacgtcctgcgccaggaaggcacgcagaaaagcgtcatcgacaccatgcagacccgcaacgagctgtacgaaagcatcaactactaccagtacgaagagaagctcgacaacctgtttgcccgtagccaggtgaaataaaaaacgcccgttgattgtattcgacagccgatgcctgatgcgtcgctgacgcgacttatcaggcctacgaggtgcactgaactgtaggtcggataagacggatggcgtcgcatccgacaaccgatgcctgatgcgccgctgacgtgacttatcaggcctacggggtgcactgaactgtaggtcggataagacgcatagcgtcgcatccgacaaccgatgcctgatgcgccgctgacgcgacttatcaggcctacggggtgcactgaactgtaggtcggataagacgcatagcgtcgcatccgacaaccgatgcctgatgcgccgctgacgcgacttatcaggcctacggggtgaactgaactgtaggtcggataagacgcatagcgtcgcatccgacaacaatctcgaccctacaaatgataacaatgacgaggacaacatgagcgacacaacgatcctgcaaaacagtacccatgtcattaaaccgaaaaaatctgtggcactttctggcgttccggcgggcaatacggcgctctgcaccgtgggtaaaagtggcaatgacctgcattaccgcggctacgatattcttgatctggcgaaacattgcgaatttgaagaagtggcgcatctgctgatccacggcaaactgccgacccgtgacgaactcgccgcttacaaaacgaaactgaaagccctgcgcggtttaccggctaacgtgcgtaccgtgctggaagccttaccggcggcgtcgcacccgatggatgttatgcgcaccggtgtttccgcgctcggctgcacgctgccagaaaaagaggggcataccgtctctggcgcgcgggatattgccgacaaactgctggcgtcgcttagctcgattctcctttattggtatcactacagccacaacggcgaacgcatccaaccggaaaccgatgacgactccatcggcggtcacttcctgcatctgctgcacggcgaaaagccatcgcaaagctgggaaaaggcgatgcatatctcgctggtgctgtacgccgaacacgagtttaacgcctccacctttaccagtcgggtgattgcgggcaccggctctgatatgtattccgcgattattggcgcgattggcgcactgcgcgggccaaaacacggcggggcgaatgaagtgtcgctggagatccagcaacgctacgaaacgccggacgaagccgaagcagatatccgcaagcgcgtggaaaacaaagaagtggtcattggttttggtcatccggtttacaccatcgctgacccgcgccaccaggtgattaaacgtgtggcgaagcagctctcgcaggaaggcggctcgctgaagatgtacaacatcgccgatcgcctggaaacggtgatgtgggagagcaaaaagatgttccccaatctcgactggttctctgctgtttcctacaacatgatgggcgttcccaccgagatgttcacaccactgtttgttatcgcccgcgtcaccggctgggcggcgcacattatcgaacaacgtcaggacaacaaaattatccgtccttccgccaattatgttggaccggaagaccgcccgtttgtcgcgctggataagcgccagtaaacctctacgaataacaataaggaaacgtacccaatgtcagctcaaatcaacaacatccgcccggaatttgatcgtgaaatcgttgatatcgtcgattacgtcatgaactacgaaatcagctctaaagtggcctacgacaccgcacattactgcctgctcgacacgctcggctgcggtctggaagctctcgaatacccggcctgtaaaaaactgctggggccaattgttcccggcaccgtcgtacccaacggcgtgcgcgtccccggaactcagttccagctcgaccccgtccaggcggcatttaacatcggcgcgatgatccgctggctcgatttcaacgatacctggctggcggcggagtggggccatccttccgacaacctcggcggcattctggcaacggcggactggctttcgcgcaacgcggtcgccagcggcaaagcgccgttgaccatgaaacaggtgctgaccgcaatgatcaaagcccatgaaattcagggctgcatcgcgctggaaaactcctttaaccgcgtcggcctcgaccacgttctgttagtgaaagtggcttccaccgccgtggtcgccgaaatgctcggcctgacccgcgaggaaattctcaacgccgtttcgctggcgtgggtggacggtcagtcgctgcgcacctatcgccatgcgccgaacaccggcacgcgtaaatcctgggcggcgggcgatgccacttcccgcgcggtacgtctggcactgatggcgaaaacgggcgaaatgggttacccgtcagccctgactgcgccggtgtggggcttctacgacgtctcctttaaaggtgaatcgttccgcttccagcgcccgtacggttcctacgttatggaaaatgtgctgttcaaaatctccttcccggcggagttccactcccagacggcagttgaagcagcgatgacgctctatgaacagatgcaggcagcaggcaaaacggcggcggatatcgaaaaagtgaccattcgcacccacgaagcctgtattcgcatcatcgacaaaaaagggccgctcaataacccggcagaccgcgatcactgcattcagtacatggtggcgatcccgctgctattcgggcgcttaacggcggcagattacgaggacaacgttgcgcaagataaacgcattgacgccctgcgcgagaagatcaattgctttgaagatccggcatttaccgctgactaccacgacccggaaaaacgcgccatcgccaatgccattacccttgagttcaccgacggcacacgatttgaagaagtggtggtggagtaccccattggtcatgctcgccgccgtcaggatggtattccgaaactggtcgataaattcaaaatcaatctcgcgcgccagttcccgactcgccaacagcagcgcattctggaggtttctctcgacagagctcgcctggaacagatgccggtcaatgagtatctcgacctgtacgtcatttaagtaaacggcggtaaggcgtaagttcaacaggagagcattatgtcttttagcgaattttatcagcgttcgattaacgaaccggagcagttctgggccgagcaggcccggcgtattgactggcagacgccctttacgcaaacgctcgatcacagcaatccgccgtttgcccgttggttttgtgaaggccgaaccaacttgtgccacaacgccatcgaccgctggctggagaaacagccagaggcgctggcgctgattgccgtctcttcggaaacagaagaagagcgcacctttacctttcgtcagctgcatgacgaagtgaacgcggtggcctcaatgttgcgttcattgggtgtgcagcgcggcgatcgggtgctggtgtatatgccgatgattgccgaagcgcatattactctgctggcctgcgcgcgcattggcgctattcactcggtggtgtttggtggatttgcctcgcacagcgtggcggcgcgaattgatgacgctaaaccggtgctgattgtctcggctgatgccggagcgcgcggtggcaaaatcattccctataaaaaattgctcgacgatgcgataagtcaggcgcagcaccagccacgccatgttttgctggtggatcgcgggctggcgaaaatggcgcgcgtcagcgggcgggatgtcgatttcgcgtcgttgcgccatcaacacatcggcgcgcgggtaccggtggcgtggctggaatccaacgaaacctcctgcattctctacacttccggcacgaccggcaaacctaaaggcgtgcagcgtgacgtcggcggatatgcggtggcgctggcgacctcgatggacaccatttttggcggcaaagcgggcagcgtgttcttttgcgcatcggatatcggctgggtggtggggcattcgtatatcgtttacgcgccgctgctggcggggatggcgactatcgtttacgaaggattgccgacctggccggactgcggcgtgtggtggacaatcgtcgagaaatatcaggttagccggatgttctcagcgccgaccgccattcgcgtgctgaaaaaattccctaccgctgaaattcgcaaacacgatctctcgtcgctggaagtgctctatctggctggagaaccgctggacgagccgaccgccagttgggtgagcaatacgctggatgtgccggtcatcgacaactactggcagaccgaatccggctggccgattatggcgattgctcgcggtctggacgacaggccgacgcgtctgggaagccccggtgtgccgatgtatggctataacgtgcagttgcttaatgaagtcaccggcgaaccgtgtggcgtcaacgagaaagggatgctggtggtggaagggccgctgccgccggggtgtattcagaccatctggggcgacgacggccgctttgtgaagacttactggtcgctgttttcccgcccggtgtacgccacctttgactggggcatccgtgacgctgacggttatcactttattctcgggcgcactgacgatgtaattaacgttgccgggcatcggctggggacgcgcgagattgaagagagtatctccagccatccgggcgttgccgaagtggcggtggttggggtgaaagatgcgctgaaagggcaggtggcggtggcgtttgtcattccgaaagagagcgacagtctggaagatcgtgatgtggcgcactcgcaagagaaggcgattatggcgctggtggacagccagattggcaactttggccgcccggcgcacgtctggtttgtctcgcaattgccaaaaacgcgatccggaaaaatgctgcgccgcacgatccaggcgatttgcgaaggacgcgatcctggagatctgacgaccattgatgatcctgcgtcgttggatcagatccgccaggcgatggaagagtaggttattgtcggatgcgtcgcgcggtgcatccggcactgtgtgccgatgcctgatgcgacgctgacgcgttttatcatgcctacggacctgaaccgtaggtcggataaggcgctcgcgtcgcatccgacaccatgctcagatgcctgatgcgacgctgacgcgtcttatcaggcctacccactgtttttacaccgataatttttcccccacctttttgcactcattcatataaaaaatatatttccccacgaaaacgattgctttttatcttcagatgaatagaatgcggcggattttttgggtttcaaacagcaaaaagggggaatttcgtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttctcggttacattggcgcaaaaaccggcctgaccactcatcttcttgctcgcttctcgtttggtgttaaaggctcatggctgccttcactgctactgggcggaactcaggttggctggtttggcgtcggtgtggcgatgtttgccattccggtgggtaaggcaaccgggctggatattaatttgctgattgccgtttccggtttactgatgaccgtcaccgtcttttttggcatttcggcgctgacggttctttcggtgattgcggttccggctatcgcctgcctgggcggttattccgtgtggctggctgttaacggcatgggcggcctggacgcattaaaagcggtcgttcccgcacaaccgttagatttcaatgtcgcgctggcgctggttgtggggtcatttatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactgggcatggcggatatctctgatgtgatgattgctcagggcctgctgctgcctgcgattgtggtgctggggctgaatatctggaccaccaacgataacgcactctatgcgtcgggtttaggtttcgccaacattaccgggatgtcgagcaaaaccctttcggtaatcaacggtattatcggtacggtctgcgcattatggctgtataacaattttgtcggctggttgaccttcctttcggcagctattcctccagtgggtggcgtgatcatcgccgactatctgatgaaccgtcgccgctatgagcactttgcgaccacgcgtatgatgagtgtcaattgggtggcgattctggcggtcgccttggggattgctgcaggccactggttaccgggaattgttccggtcaacgcggtattaggtggcgcgctgagctatctgatccttaacccgattttgaatcgtaaaacgacagcagcaatgacgcatgtggaggctaacagtgtcgaataacgctttacaaacaattattaacgcccggttaccaggcgaagaggggctgtggcagattcatctgcaggacggaaaaatcagcgccattgatgcgcaatccggcgtgatgcccataactgaaaacagcctggatgccgaacaaggtttagttataccgccgtttgtggagccacatattcacctggacaccacgcaaaccgccggacaaccgaactggaatcagtccggcacgctgtttgaaggcattgaacgctgggccgagcgcaaagcgttattaacccatgacgatgtgaaacaacgcgcatggcaaacgctgaaatggcagattgccaacggcattcagcatgtgcgtacccatgtcgatgtttcggatgcaacgctaactgcgctgaaagcaatgctggaagtgaagcaggaagtcgcgccgtggattgatctgcaaatcgtcgccttccctcaggaagggattttgtcgtatcccaacggtgaagcgttgctggaagaggcgttacgcttaggggcagatgtagtgggggcgattccgcattttgaatttacccgtgaatacggcgtggagtcgctgcataaaaccttcgccctggcgcaaaaatacgaccgtctcatcgacgttcactgtgatgagatcgatgacgagcagtcgcgctttgtcgaaaccgttgctgccctggcgcaccatgaaggcatgggcgcgcgagtcaccgccagccacaccacggcaatgcactcctataacggggcgtatacctcacgcctgttccgcttgctgaaaatgtccggtattaactttgtcgccaacccgctggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagttgatgggctacgggcagattaacgatggcctgaatttaatcacccaccacagcgcaaggacgttgaatttgcaggattacggcattgccgccggaaacagcgccaacctgattatcctgccggctgaaaatgggtttgatgcgctgcgccgtcaggttccggtacgttattcggtacgtggcggcaaggtgattgccagcacacaaccggcacaaaccaccgtatatctggagcagccagaagccatcgattacaaacgttgaacgactgggttacagcgagcttagtttatgccggatgcggcgtgaacgccttatccggcctacgtagagcactgaactcgtaggcctgataagcgtagcgcatcaggcaattccagccgctgatctgtgtcagcggctaccgtgattcattcccgccaacaaccgcgcattcctccaacgccatgtgcaaaaatgccttcgcagcggctgtctgccagctgtagtttatgccggatgcggcgtgaacgccttatccggcctacgtagagcactgaactcgtaggcctgataagcgtagcgcatcaggcaattccagccgcagacctgtgtcagcggctaccgtgattcatttccgccaacaaccgcgcatttatccaacgccatgtgcaaaaatgccttcgcggcggctgtctgccagctatttttccgccgcaacaaaaccgccgttctctccagtagtggcggggcaagagaaatagctttaagcccgtcatgttgtgtggcaatcgctgctggtaacaatgtggaaagggaagtgcggcgaatcagctccagaaccgcgctaattgagttcgcctcaatgaccacctgtggatgtagccccgctttctcgcagtagtggtcaatttgctctctggtggcaaattccgcgctgagcaggaccagtttttcatcatgcaagcgactcaacgccacctgttcatggacggccagcggatgatgttgcgccacgactaacgctaaactttctgtcagtaaaggaattgcctccagctccggcgaatgcacaggcgcgaaggcaatcccaacgtccaactcgtcgcggcaaagcatatcctcgattttctcctgcgacatttcctgtagctggagcgtgatgctgggatagcgcgcatagaaatccgccattaaggggccgataaagtagctcgtaaaggtgggggtgacggcgatacgcagcgatcctcgcgtcagatcggcaacatcatgaatcgcccgtttacccgcccccagttcctgtaacgcccggctggcgtactgtcgccagacttctcctgcatcagtgagacgaatcgttcgcccgctacggtcaaacagcggcacgcctaaactctcctctaactggcgaatctgctgggaaagcgcaggttgggagacgtgcaacgcactggcggcacgggtgaagctgccatgttcagccacggcaagaaaataattgatatgtcgagagagcattcgcaacctataagtaaatccaatggaactcatcataaatgagacttttaccttatgacaatcggcgagtagtctgcctctcattccagagacagacagaggttaacggtgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaaccttatttttaaaccatcaggagttccaccatgattcagtcacaaattaaccgcaatattcgtcttgatcttgccgatgccattttgctcagcaaagctaaaaaagatctctcatttgccgagattgccgacggcaccggtctggcagaagcctttgtaaccgcggctttgctgggtcagcaggcgcttcctgccgacgccgcccgcctggtcggggcgaagctggatctcgacgaagactccattctactgttgcagatgattccactgcgtggctgcattgatgaccgtattccaactgacccaacgatgtatcgtttctatgaaatgttgcaggtgtacggtacaaccctgaaagcgttggttcatgagaaatttggcgatggcattattagcgcgattaacttcaaactcgacgttaagaaagtggcggacccggaaggtggcgaacgtgcggtcatcaccttagatggtaaatatctgccgaccaaaccgttctgacagccatgcgcaaccatcaaaagacgttcacgatgctgctggtactggtgctgattggtcttaatatgcgaccactgctcacctccgtcgggccactgctaccgcaattgcgccaggcgagcggaatgagctttagcgtggctgccctgttgaccgctctgccggtggttaccatgggcgggctggcgctggccggaagctggcttcatcagcatgtcagcgaacgtcgcagtgtcgccatcagtctgttgctgattgccgtcggtgcattgatgcgtgagctttacccgcaaagtgcgctgctgcttagcagcgcactgcttggtggggtggggatcggcatcattcaggcggtgatgccttcggtgattaaacggcggtttcagcagcgcacgccactggtgatggggctgtggtccgcggctctgatgggcggcggtgggcttggtgccgccataacgccctggttagttcaacatagcgaaacctggtatcaaacactcgcctggtgggcgctgcctgccgttgttgcgctctttgcctggtggtggcaaagcgcccgcgaggtcgcctcttcccacaagacaacaaccactccggttcgcgtggtattcactccccgcgcgtggacgctgggtgtttacttcggtctgattaacggcggttacgccagcctgattgcctggttacccgctttctatattgagattggtgccagcgcgcagtacagcggttccttactggcattgatgacgcttgggcaagccgcaggagctttgctgatgcctgctatggctcgccatcaggatcggcgcaaactgttaatgctggcgctggtgttacaactggtggggttctgcggctttatctggctgccgatgcaattgccggtattgtgggcgatggtgtgtgggttaggtctgggcggcgcgtttccgctctgtttgctgctggcgctcgatcactctgtgcaaccggctattgctggcaagctggtggcgtttatgcagggaatcggttttatcatcgccgggcttgccccgtggttttctggcgtgctgcgtagtatcagcggcaattacctgatggactgggcatttcatgcgctgtgcgtcgttgggctgatgatcataaccctgcgttttgcaccagtacgttttccgcagctgtgggtcaaagaggcatgatgcgacgcttgttcctgcgctttgttcatgccggatgcggctaatgtagatcgctgaacttgtaggcctgataagcgcagcgtatcaggcaatttttataatttaaactgacgattcaactttataatctttgaaataatagtgcttatcccggtcgtttatttcgcgaataacccgacaaggaacgccagccgccacgacgtttggtggaatgtcttttgtgacgatactacccgcgccaataacagaattatccccgatggtgacgcctggattaataaccacatgacttccgatccagacgttattgccaatcgttatcggaaaagagtacatctcgccgttttttctcaattcatggtgtacagggtgtcccgtaacggaaagagtaacgttgggtgcaatcagtacgttatcaccgattgttaccgtgtagtcatcgacaatggttaaattgaaatttgcataaaaattgcggcctatatggatgttggaaccgtaagagaaatagacaggcggttctacccaggcgttttcccctaccgtggcaaacatttctttaatcaggctttctcttttttcaacttctgatggatgcgagtgattaaactcatacattaacgttttcccacgaagtcttttttccggtaagccttcgcacatatcggtaaatagcttgcctgctcttattctttcggtcattggcatgttcaatgcgatcactccgttatgatatgttggtcggataaggcgctcgcgccgcatccgacattgattgcttaagcgacttcattcacctgacgacgcagcagggaaagcgggccggggccgctaagcgtgaacacggaaattaaggtgaagcccagcgccaccagacccagcaccagataagcgccctggaaaccgatgctttcatacatattgcccgccagtacagacataaaaatcatcgccagttgcttaaagaagcagaaacagaccagataaatcgtcgctgaaaaacgcacttcaaactggctggtaatatatttaaagcagcccaccagcaggaacggtacttcaaacatatgcagcgttttcagaataaccacttccagcgctgaggtggcgaacgatgagccaataatacgtacagacataatagtgccagccagcagcagggcgtttttcccaccgatgcgattaatgatcagtggcgcaaagaacataatcgaggcgttaagtaattcgcccattgtcgttacgtagccaaatacccgcgtaccctgttcaccggtagcaaagaacgaagtaaagaaattagcaaactgttggtcaaaaacatcgtaggtgcaggaaacgccaataacatacagtgacaaaaaccacagttttggctgtctgaacagttccagtgccagcttaaggctaaatgccgaatggttggcacctaccgcattggcaaccgtggcagaagagggcgcatccgttttggcgaaaaagagtaaaacggcgaggatgagtgcacagccagagcccagccagaaaacaaactgattattgatggtgaacatgatgccgacaatcgaggcacacagcgcccagccaacacagccaaacatccgcgcgcgaccaaattcgaaattactgcgacggctgactttctcaataaatgcctctactgctggcgcaccggcgttaaaacaaaagcctagataaataccaccaacaatcgatcctactaaaatgttgtattgtaacagtggcccgaagataaaaataaagaacggcgcaaacatcactaacatgccggtaataatccacagcaggtatttgcgcagcccgagtttgtcagaaagcagaccaaacagcggttggaataatagcgagaacagagaaatagcggcaaaaataatacccgtatcacttttgctgatatggttgatgtcatgtagccaaatcgggaaaaacgggaagtaggctcccatgataaaaaagtaaaagaaaaagaataaaccgaacatccaaaagtttgtgttttttaaatagtacataatggatttccttacgcgaaatacgggcagacatggcctgcccggttattattatttttgacaccagaccaactggtaatggtagcgaccggcgctcagctggaattccgccgatactgacgggctccaggagtcgtcgccaccaatccccatatggaaaccgtcgatattcagccatgtgccttcttccgcgtgcagcagatggcgatggctggtttccatcagttgctgttgactgtagcggctgatgttgaactggaagtcgccgcgccactggtgtgggccataattcaattcgcgcgtcccgcagcgcagaccgttttcgctcgggaagacgtacggggtatacatgtctgacaatggcagatcccagcggtcaaaacaggcggcagtaaggcggtcgggatagttttcttgcggccctaatccgagccagtttacccgctctgctacctgcgccagctggcagttcaggccaatccgcgccggatgcggtgtatcgctcgccacttcaacatcaacggtaatcgccatttgaccactaccatcaatccggtaggttttccggctgataaataaggttttcccctgatgctgccacgcgtgagcggtcgtaatcagcaccgcatcagcaagtgtatctgccgtgcactgcaacaacgctgcttcggcctggtaatggcccgccgccttccagcgttcgacccaggcgttagggtcaatgcgggtcgcttcacttacgccaatgtcgttatccagcggtgcacgggtgaactgatcgcgcagcggcgtcagcagttgttttttatcgccaatccacatctgtgaaagaaagcctgactggcggttaaattgccaacgcttattacccagctcgatgcaaaaatccatttcgctggtggtcagatgcgggatggcgtgggacgcggcggggagcgtcacactgaggttttccgccagacgccactgctgccaggcgctgatgtgcccggcttctgaccatgcggtcgcgttcggttgcactacgcgtactgtgagccagagttgcccggcgctctccggctgcggtagttcaggcagttcaatcaactgtttaccttgtggagcgacatccagaggcacttcaccgcttgccagcggcttaccatccagcgccaccatccagtgcaggagctcgttatcgctatgacggaacaggtattcgctggtcacttcgatggtttgcccggataaacggaactggaaaaactgctgctggtgttttgcttccgtcagcgctggatgcggcgtgcggtcggcaaagaccagaccgttcatacagaactggcgatcgttcggcgtatcgccaaaatcaccgccgtaagccgaccacgggttgccgttttcatcatatttaatcagcgactgatccacccagtcccagacgaagccgccctgtaaacggggatactgacgaaacgcctgccagtatttagcgaaaccgccaagactgttacccatcgcgtgggcgtattcgcaaaggatcagcgggcgcgtctctccaggtagcgaaagccattttttgatggaccatttcggcacagccgggaagggctggtcttcatccacgcgcgcgtacatcgggcaaataatatcggtggccgtggtgtcggctccgccgccttcatactgcaccgggcgggaaggatcgacagatttgatccagcgatacagcgcgtcgtgattagcgccgtggcctgattcattccccagcgaccagatgatcacactcgggtgattacgatcgcgctgcaccattcgcgttacgcgttcgctcatcgccggtagccagcgcggatcatcggtcagacgattcattggcaccatgccgtgggtttcaatattggcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgcctcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagtttcgggttttcgacgttcagacgtagtgtgacgcgatcggcataaccaccacgctcatcgataatttcaccgccgaaaggcgcggtgccgctggcgacctgcgtttcaccctgccataaagaaactgttacccgtaggtagtcacgcaactcgccgcacatctgaacttcagcctccagtacagcgcggctgaaatcatcattaaagcgagtggcaacatggaaatcgctgatttgtgtagtcggtttatgcagcaacgagacgtcacggaaaatgccgctcatccgccacatatcctgatcttccagataactgccgtcactccagcgcagcaccatcaccgcgaggcggttttctccggcgcgtaaaaatgcgctcaggtcaaattcagacggcaaacgactgtcctggccgtaaccgacccagcgcccgttgcaccacagatgaaacgccgagttaacgccatcaaaaataattcgcgtctggccttcctgtagccagctttcatcaacattaaatgtgagcgagtaacaacccgtcggattctccgtgggaacaaacggcggattgaccgtaatgggataggtcacgttggtgtagatgggcgcatcgtaaccgtgcatctgccagtttgaggggacgacgacagtatcggcctcaggaagatcgcactccagccagctttccggcaccgcttctggtgccggaaaccaggcaaagcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaatccgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcaacgtaaatgcatgccgcttcgccttccggccaccagaatagcctgcgattcaaccccttcttcgatctgttttgctacccgttgtagcgccggaagatgcttttccgctgcctgttcaatggtcattgcgctcgccatatacaccagattcagacagccaatcacccgttgttcactgcgcagcggtacggcgatagaggcgatcttctcctcctgatcccagccgcggtagttctgtccgtaaccctctttgcgcgcgcgcgccagaatggcttccagctttaacggttcccgtgccagttgatagtcatcaccggggcgggaggctaacatttcgattaattccttgcggtcttgttccgggcaaaaggccagccaggtcaggcccgaggcggttttcagaagcggcaaacgtcgcccgaccattgcccggtgaaaggataagcggctgaaacggtgagtggtttcgcgtaccaccattgcatcaacatccagcgtggacacatctgtcggccataccacttcgcgcaacagatcgcccagcagtggggccgccagtgcagaaatccactgttcgtcacgaaatccttcgcttaattgccgcactttgatggtcagtcgaaaactatcatcggaggggctacggcggacatatccctcttcctgcagcgtctccagcagtcgccgcacagtggtgcgatgcaggccgctgagttccgccagcagcccgacgctggcaccgccatcaagtttatttaacatatttaataacattagaccgcgggttaagccgcgcacggttttgtattccgtctgctcattgttctgcatattaattgacatttctatagttaaaacaacgtggtgcacctggtgcacattcgggcatgttttgattgtagccgaaaacacccttcctatactgagcgcacaataaaaaatcatttacatgtttttaacaaaataagttgcgctgtactgtgcgcgcaacgacattttgtccgagtcgtgaggtactgaaatggcaatacaacaccctgacatccagcctgctgttaaccatagcgttcaggtggcgatcgctggtgccggcccggttgggctgatgatggcgaactatctcggccagatgggcattgacgtgctggtggtggagaaactcgataagttgatcgactacccgcgtgcgattggtattgatgacgaggcgctgcgcaccatgcagtcggtcggcctggtcgatgatgttctgccgcacactacgccgtggcacgcgatgcgttttctcaccccgaaaggccgctgttttgctgatattcagccaatgaccgatgaatttggctggccgcgccgtaacgcctttattcagccgcaggtcgatgcggtgatgctggaaggggtgtcgcgttttccgaatgtgcgctgcttgttttcccgcgagctggaggccttcagtcagcaagatgacgaagtgaccttgcacctgaaaacggcagaagggcagcgggaaatagtcaaagcccagtggctggtagcctgtgacggtggagcaagttttgtccgtcgcactctgaatgtgccgtttgaaggtaaaactgcgccaaatcagtggattgtggtagatatcgccaacgatccgttaagtacgccgcatatctatttgtgttgcgatccggtgcgcccgtatgtttctgccgcgctgcctcatgcggtacgtcgctttgaatttatggtgatgccgggagaaaccgaagagcagctgcgtgagccgcaaaatatgcgcaagctgttaagcaaagtgctgcctaatccggacaatgttgaattgattcgccagcgtgtctacacccacaacgcgcgactggcgcaacgtttccgtattgatcgcgtactgctggcgggcgatgccgcgcacatcatgccggtatggcaggggcagggctataacagtggtatgcgcgacgcctttaacctcgcatggaaactggcgttggttatccaggggaaagcccgcgatgcgctgctcgatacctatcaacaagaacgtcgcgatcacgccaaagcgatgattgacctgtccgtgacggcgggcaacgtgctggctccgccgaaacgctggcagggtacgttacgtgacggcgtttcctggctgttgaattatctgccgccagtaaaacgctacttcctcgaaatgcgcttcaagccgatgccgcaatattacggcggtgcgctgatgcgtgagggcgaagcgaagcactctccggtcggcaagatgtttattcagccgaaagtcacgctggaaaacggcgacgtgacgctgctcgataacgcgatcggcgcgaacttcgcggtaattggctggggatgcaatccactgtgggggatgagcgacgagcaaatccagcagtggcgcgcgttgggcacacgcttcattcaggtggtgccggaagtgcaaattcataccgcacaggataaccacgacggcgtactacgcgtgggcgatacgcaaggtcgcctgcgtagctggttcgcgcaacacaatgcttcgctggtggtgatgcgcccggatcgctttgttgccgccaccgccattccgcaaaccctgggcaagaccctgaataaactggcgtcggtgatgacgctgacccgccctgatgccgacgtttctgtcgaaaaggtagcctgatatgcacgcttatcttcactgtctttcccactcgccgctggtggggtatgtcgacccggcgcaagaggtgctcgatgaggtcaatggcgtgattgccagcgcccgcgagcgtattgcggcattctcccctgaactggtggtgctgtttgcgccagatcactacaacggctttttctatgacgtgatgccaccgttctgtttaggcgttggagcgacggcaattggtgatttcggcagtgcggcaggagagctgcccgtgcctgtggagctggcggaggcctgtgcgcatgccgtcatgaagagcgggatcgatcttgccgtttcttactgtatgcaggtggaccacgggttcgcccagccgctggagttcctgctcggtgggctggataaggtgccagttctgcctgtgttcatcaacggtgtcgccacgccgctgcccggtttccagcgtacccgcatgttgggtgaagccattggacgtttcaccagcactctcaataaacgcgtgctgttcctgggttccggtgggctttcccatcagccgccggtgcccgaactggcgaaagccgatgcccatatgcgcgaccgtctgttggggagcgggaaagatttacccgccagtgagcgcgaattgcgtcagcaacgggtgattagcgccgctgagaagtttgttgaggatcagagaacgctgcatccgctcaacccgatttgggataaccagttcatgactttgctggagcagggacgcatacaggaactggatgccgtcagtaacgaagagctttccgccattgccggaaagtcgacacatgaaatcaaaacctgggtcgccgcttttgccgctatttctgcgtttggcaactggcgtagcgaagggcgttattaccgcccaatcccggagtggattgccggatttggctcgttaagcgccagaacagagaactgaatatgcaggagaagatgatgagttatcagccacaaaccgaagccgccaccagccgttttctgaatgtagaagaagcgggtaaaacgctgcgcatccattttaatgactgcggacaaggcgacgaaaccgttgtcctgctgcatggttccggcccgggtgctactggctgggcgaacttcagccgcaatatcgatccgctggtagaggcgggctatcgggtgatcctgctggattgtccgggttggggcaagagcgattcggtcgttaatagtggttcgcgatcggatcttaatgcacgaatcctgaaaagcgtggtggatcaactggatatcgccaaaatccacctgctgggcaactcgatggggggccatagttctgtggcgttcacccttaaatggccggagcgcgtcggcaaactggtgctgatgggcggcggtacgggcggcatgagtttgtttacgccgatgccaaccgaaggtattaagcgactgaatcagctttatcgtcagccgactatcgaaaacctgaagctgatgatggatatcttcgtttttgataccagcgatttgaccgacgccctgtttgaagcgcgcctgaataatatgctgtcgcgccgcgatcacctggaaaacttcgttaagagcctggaagctaatccgaaacagttcccggattttggcccacgtctggcggaaatcaaagcgcaaaccctgattgtctgggggcgcaacgaccgctttgtgccgatggatgcgggtctgcgtctgctgtccggcattgccggttctgaactgcatatcttccgcgactgtggtcactgggcgcagtgggaacatgccgacgctttcaatcaactggtgctgaatttcctcgcacgcccttaaggaatggtcatgacgaagcatactcttgagcaactggcggcggatttacgccgcgccgcagagcagggcgaagcgattgcaccgctgcgcgatctgattggtatcgataacgctgaagcggcttacgccattcagcacataaatgtgcaacatgacgttgcgcaggggcgtcgcgtggtagggcgtaaagtgggcctgacacatccgaaagtgcaacaacaactgggcgttgatcaaccggattttgggacgttatttgccgacatgtgttatggcgataacgaaatcattcctttttcccgtgttctgcaaccccgcattgaagcggagatcgcactggtgttgaaccgcgatttgcccgcaaccgatatcaccttcgacgaattgtataacgccattgaatgggtacttccggcgctggaagtggtggggagccgcattcgcgactggtcgattcagtttgtcgataccgtggcagataacgcctcctgtggggtgtatgtcatcggcggtccggcgcaacgtccggcggggttagacctgaaaaactgcgccatgaagatgacgcgtaataacgaagaggtttctagcgggcgcggcagcgaatgcctgggacatccgcttaatgcggccgtctggctggcacgcaaaatggccagtctgggtgaaccgctgcgcaccggagatatcattcttaccggggcattaggtccgatggtggcggtgaatgcgggcgatcgttttgaagcccatattgaaggcataggttcagttgctgcgacattttcaagcgcagccccaaaaggaagtctgtcatgagtaagcgtaaagtcgccattatcggttctggcaacattggtaccgatctgatgattaaaattttgcgtcacggtcagcatctggagatggcggtgatggttggcattgatcctcagtccgacggtctggcgcgcgccagacgtatgggcgtcgccaccacccatgaaggggtgatcggactgatgaacatgcctgaatttgctgatatcgacattgtatttgatgcgaccagcgccggtgctcatgtgaaaaacgatgccgctttacgcgaagcgaaaccggatattcgcttaattgacctgacgcctgctgccatcggcccttactgcgtgccggtggttaacctcgaggcgaacgtcgatcaactgaacgtcaacatggtcacctgcggcggccaggccaccattccaatggtggcggcagtttcacgcgtggcgcgtgttcattacgccgaaattatcgcttctatcgccagtaaatctgccggacctggcacgcgtgccaatatcgatgaatttacggaaaccacttcccgagccattgaagtggtgggcggcgcggcaaaagggaaggcgattattgtgcttaacccagcagagccaccgttgatgatgcgtgacacggtgtatgtattgagcgacgaagcttcacaagatgatatcgaagcctcaatcaatgaaatggctgaggcggtgcaggcttacgtaccgggttatcgcctgaaacagcgcgtgcagtttgaagttatcccgcaggataaaccggtcaatttaccgggcgtggggcaattctccggactgaaaacagcggtctggctggaagtcgaaggcgcagcgcattatctgcctgcctatgcgggcaacctcgacattatgacttccagtgcgctggcgacagcggaaaaaatggcccagtcactggcgcgcaaggcaggagaagcggcatgaacggtaaaaaactttatatctcggacgtcacattgcgtgacggtatgcacgccattcgtcatcagtattcgctggaaaacgttcgccagattgccaaagcactggacgatgcccgcgtggattcgattgaagtggcccacggcgacggtttgcaaggttccagctttaactatggtttcggcgcacatagcgaccttgaatggattgaagcggcggcggatgtggtgaagcacgccaaaatcgcgacgttgttgctgccaggaatcggcactattcacgatctgaaaaatgcctggcaggctggcgcgcgggtggttcgtgtggcaacgcactgtaccgaagctgatgtttccgcccagcatattcagtatgcccgcgagctcggaatggacaccgttggttttctgatgatgagccatatgaccacgccggagaatctcgccaagcaggcaaagctgatggaaggctacggtgcgacctgtatttatgtggtggattctggcggtgcgatgaacatgagcgatatccgtgaccgtttccgcgccctgaaagcagagctgaaaccagaaacgcaaactggcatgcacgctcaccataacctgagtcttggcgtggcgaactctatcgcggcggtggaagagggctgcgaccgaatcgacgccagcctcgcgggaatgggcgcgggcgcaggtaacgcaccgctggaagtgtttattgccgccgcggataaactgggctggcagcatgggaccgatctctatgcgttaatggatgccgccgacgacctggtgcgtccgttgcaggatcgaccggtacgagtcgatcgcgaaacgctggcgctgggatacgctggtgtttactcgagcttcctgcgtcactgtgaaacggcggcggcgcgttatggcttaagtgcggtggatattctcgttgagctgggcaaacgccggatggttggcggccaggaggatatgatcgttgacgtggcgctggatctgcgcaacaacaaataatgatgactgccgagaacgtgcattttgtatgcccatcccagcacgactgccggatgcggcgtgaacgccttatccggcctacggatggcgtgagaatttgtaggtctgataagacgcgttagcgtcgcatcaggcatctgcgcacgactgccggatgcggcgtgaacgccttatccggcctacggatggcgcgggaatttgtaggcctgataagacgcgttagcgtcgcatcaggcatctgcgcacgactgccggatgcggcgtgaacgccttatccggcctacgggtggcgcgagaatttgtaggcctgataagacgcgttagcgtcgcatcaggcatctgcgcacgactgccggatgcggcgtaaacgccttatccggcctacggatggcgcgggaatttgtaggcctgataagacgcgttagcgtcgcatcaggcatctgcacacgactgccggatgcgataaacgtcttgtccggcctacatttcgcccgtaggcagtcattaaatagttctgattacgcggctggcaatgtatcagtcgcgattcacctgcactcgcaacgaggttcatcttatgtcgactcgtaccccttcatcatcttcatcccgcctgatgctgaccatcgggctttgttttttggtcgctctgatggaagggctggatcttcaggcggctggcattgcggcgggtggcatcgcccaggctttcgcactcgataaaatgcaaatgggctggatatttagcgccggaatactcggtttgctacccggcgcgttggttggcggaatgctggcggaccgttatggtcgcaagcgcattttgattggctcagttgcgctgtttggtttgttctcactggcaacggcgattgcctgggatttcccctcactggtctttgcgcggctgatgaccggtgtcgggctgggggcggcgttgccgaatcttatcgccctgacgtctgaagccgcgggtccacgttttcgtgggacggcagtgagcctgatgtattgcggtgttcccattggcgcggcgctggcggcgacactgggtttcgcgggggcaaacttagcatggcaaacggtgttttgggtaggtggtgtggtgccgttgattctggtgccgctattaatgcgctggctgccggagtcggcggttttcgctggcgaaaaacagtctgcgccaccactgcgtgccttatttgcgccagaaacggcaaccgcgacgctgctgctgtggttgtgttatttcttcactctgctggtggtctacatgttgatcaactggctaccgctacttttggtggagcaaggattccagccatcgcaggcggcaggggtgatgtttgccctgcaaatgggggcggcaagcgggacgttaatgttgggcgcattgatggataagctgcgtccagtaaccatgtcgctactgatttatagcggcatgttagcttcgctgctggcgcttggaacggtgtcgtcatttaacggtatgttgctggcgggatttgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggtcggcgtaatggccgcttctgcaccgggtattcttgttgctgggttggcggtgtttattttgatgagccggagatcacgaatacagccgtgcgccgatgcctgacgtgccttattaggcaggggcgaaagggacttcaccccaatacacctacggcgtttacaggtatactcgctaaaaattattcagcgggtttggaaacaaagatggcaaaacttaccttacaagagcagttgctcaaagcaggattagtcaccagcaaaaaagcggcgaaggtggagagaacggcgaaaaaatcgcgcgttcaggcgcgtgaagctcgggcggcggtagaagaaaataaaaaggcacagcttgagcgtgataaacagcttagcgaacagcaaaaacaagcggcgttggcgaaagaatataaagctcaggtgaagcagcttattgaaatgaaccgaatcaccattgccaatggcgatattggttttaacttcactgacggcaatctgattaagaagatttttgtcgataagctcacacaggcgcagttgattaatggtcgtctggcgattgcccgcttgttggtcgataacaatagcgaaggtgaatacgccattattcccgccagcgttgccgataaaattgctcagcgcgatgccagcagtatagtgttgcacagcgcgctcagcgccgaagagcaggatgaagacgacccgtatgccgacttcaaagtgcctgatgatttgatgtggtaaacatagataagtcgtgcgcagatgcctgatgcgacgctatgcgcgtcttatcaggcctacggtttatgggcgaagtgtagaccggataaggcgttcacgccgcatccggcagtcgtgcgccatgcctgatgcgacgctttgcgcgtcttatcaggcctacggcttacgggcgaagtgtaggccggataaggcgttcacgccgcatccggcagtcgtgctattatcaacgcatattcagtttattggcgtggtaggcaatatgctcgccaataaaactggagacaaaataatagctgtgatcataaccctcgtgataacggattaacgtcttgatattcatctcctggcagatcttttcaagatttggagtccgcagctgttctgcgtaaaaatcatcactcaacccctgatcaaccatgatttccgcaacgcgttgaccttgtgaaataagactcaccgggtcgtaatccaaccaggcatctttattttcagcaagatatgcagcaaaggcttgctgtccccacggcacttgcgatggggagacaatgggcgaaaacgccgagacgctgacatattcatctgggttacgtaacgccagcaccagcgcgcccagcccgcccatagaatgaccagagatagactttttggccgttgccggaaaatgatgcatcactaaatccggcagctcgttgcggatatagtcatacattttgtaatgttcattccacggcgcttgcgtcgcgttcaggtaaaacccggcaccttgcccgagatcgtaacggtcagcatctgcgacatgactgcctcgcggactggtgtccggcgcaacaacaataatgttgtgctcagccgcgtaacgctgcatccccgatttagtaatgaaattctgctcgttgcaggtcaggcctgaaagccagtacagcaccggcaatttttcattcgcggcttttggtgggagatagacgccgacattcatttcacatttcagtgattgggaataatgccgatacatattttgccagccgccaaagctgacatgtttttcaatgagttccatcagtcattatctcagggttaatcccccggacggctgcccggggagagtattaagaacccccgcctgaagtggacggggtaaacctgcgggaaatcagtaacgaattacggttcgaatggatttgccttcatgcatcaggtcgaaggcgtcattaatttcatccaggctcatggtatgcgtgacaaacggttccagatcgatatcacctttcatcgcatcttcaaccatgcccggtaactgggaacgacctttcacgccgccaaacgcggaacctttccatacgcgaccagtgaccaactggaatggacgggtggagatttcctgaccggcaaccgcgaccccgatgatcaccgactgaccccagccgcggtgcgcactttccagcgccgcacgcatcacgttgacgttaccgatgcattcaaaggtatggtcgataccccatttgttgatatccaacaggacatcttttatcggtttgtcgtagtcattcgggttaatgcagtcggtagcaccgaagcgacgcgccagatcgaatttcttcgggttggtatcgatagcgataatccgacccgctttcgcctgacgcgcgccctgaaccactgccagaccaatcgcgccaagaccaaacacggcaacagaatcacctggctggactttagctgtgttgtgtaccgcgccaataccggtggtcacgccacagcccagcaggcagacgtgttcatggtttgcttctggattaatttttgccagagacacttccgcgactacggtgtattcactgaatgtagagcaccccatgtagtgataaagcggctgcccgttgtaagaaaaacgggtggtgccgtctggcatcaggcctttaccctgggtttcgcgaaccgcaacacagaggttagttttgccagaacgacagaactcacactcgccgcactccgcggtgtaaagcgggatcacatggtcgccaggtttgacgctggttacgccttcaccgacttcaaccacaacgccggccccttcgtgaccgagaaccaccgggaatacaccttccgggtcatcgccggagagggtaaatgcgtcggtatggcaaacgccggtatgggtgactttaattagcacttcaccttttttcggtggtgcaacgtcaatttcaacgatttccagcggtttaccgggagcaaatgcaacggcagcacgtgatttcatctctcgctcttcctcaatatggtaatagattcagctatttaagataggcacgaaccagttcaatagtgtcgtcaacggattggctgacttcgcggctgtagcagtcatttcggtcaaacgtttcccggatatggctttcaagcacttctgccatcagcccattagccgcgccccgaacggcagcgatctgttggagtatggcacggcattcggcatcaccctccagcgaccgttccagagcatcaatctgcccccgaatacgacgaactcgagtaaggacctttttcttctcttccggagtactgggcatttcgcacctcatcatctgcatgcaatatactataggggggtattctatatgtcaatgcatacccccctatagtatataacactggagaataaaatttatccggtgaatgtggtcggaaaacaaagaggaaaggggggggggctaatcggcagggaaggccgccccggatagcgggcggcagaaggaatcagaatttccaggtcagacgggctgcaagttgcagaccgttaaaatcatcggttggggtgtcgtaccacactttacctgccgtcagcccgagattaagttgctcagtcagcggttgaatacgttgcagactgacgctcttcatgctgccgtagcgtgtttctggcgtccagtcataggtgtaagcacctgttccgcggcttagccatagttgcgtataaccagtgccgcgcgggtcattcagacgcacggaaatcatattgctataactaccacctgcatcgctggagtcataatgggtatagcggtagctggtgatcaccgggccagtatagagtgatacgccgccttgccaggcatcgacttcgacatcatcgtaatatttagtgtagcgataaccggtcgtgaaaagcgtttttggtaacagggccaggttaatatcctgacgaaaatcctggcgggcaaagaccggcgtattatccgcaaaggcaatacccgttcgggttgtcagccagttattccatttataccagaccgcaccctgaccgcgagtggcattgaaatgttcagtttcataatcacgacgcccctgggaaagattaaaaagcagcgttgcgttttcaactttcgccaccagttcagcatacgctaaattacggttgccatgatcgccagaataatcggtaaaatcgtagcccgcggtaatggaagttaacccggcataagcgggcaatgcgctaaaaatggccgccgctaataacgtccgttttatcattttaatctcctgtacggataagttcttgtcggagtgaataagttccggtaggtaaattacgttctacaatcacgcgcgggccaagttgcgtgttcggggaaataattcgcccaggcaaaataataacttgtacgccaaggcgtgaacgctgcccgatataacaacctaatttatcgcatccggtagcgataattccctctggagttcgaacagacacgggctgttcatccagacgatgattactggtacgtacttgtgcgcctaaatatgcctggtttgcaactaccgagtcggcaataaaacattgcggaccaatcgttgcttccgcttcaataaccgcatttttaatctcggtggcaaaaccaatttttacgccattgctgattattgtgccaggacgaataaacgcataattactagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaattacctatcaggcagtttgcgccaatcactaccggaccctgaataacggcaccatgacaaatacgggtattcgcgccgataacaacttcacctgcagtttcatcaataattacctggtctgcaatctgaatatttttctctttaacattaagcttcagatagtttttcagttcctgtgacagaaggttgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggcgctaaaggcaccaacaaccagcaacgatgaaaccaggcgctaaaagcaccaataacacaaactacgccgacccagataagcggaaacattgccaacaccactccatgcggcccggtggtgatgaattcattaaaccaggtagtgagataaatcccaacgccataaagcacaaccaacagcataggaaatatactgaagataccgaagcggctaaataaaagtcttttatgcaggcgcatacagaccgcgtatcccacaatccaacgccgccagcgacgccactcctcacgcgggctgttgcattcctgtgggtatacgatgcagcgattcgcctgccgaatacggtagccgtttgccaccaatgtccaggtgagatcaaggtcttcgactttagtacgatccgagaaaccgaacttacgcaatacatcagtacggaacatcccgcaggcaccgctgataataaacggtgcgccacccaggagctgctgtagcgtgcgcttcataacaatcatcggcaactttacggtcgcgcggatgtgcggtaacagacccgcgcctttcaacgcagtagagggaatgccgcctacggcatcggcaccgcgctcaatttctgccagcatatagcccattccgtcttgatcgggcggaacataggtgtcggcatcacttaaaaaaacctggtcgcaggtggcgtaattgaggccattcatcagcgcaccacctttaccggtatttttttgcgtgacggcaacaaagcggtcgccccatttgcgtttgacttccgccatgaccgcttcggtattgtccgtggagccgtcgttaacgcaaattacccggcaaaaataagggttacgcagtagattatccagtgactgcgccagacacgggccttcgttatacgcaggtataatggcgtcaatacagcctttcttttgactgggtttacgtcttagcgtacttaaaaaccatagcaacattgctatggacatacagataaatatccaggttttcatgcaatttgctcaaagaatcattttatgaattacaaagccttcacccagatcgctattgacctgttgtccgcgaaattgtgcaactgcacgcaggcgatcatgacgcatataatcgcgtcgttcctagcttttatgtttttttaatgcagcaagtttgactgtgaaatattcttctttaacggattcaaaaacctgaggcataaatgaaagccaggtacttggggtttcgtagccgagaatttgcggaatagttcggcaggcaaccattgaagcttgataaacagcaagatgatcctgatggcggtcggcatcatgcatggtatatacccgcatgatttcaacatcagaaggaatttgatttttaatgatgtcttccagggcggaaatcatatcattgagctgtaaatgagcgcgggtgtcagcaaaattaagatgaatagtttggtggcaccctaatatctttagggcgttgcgcgattcttcatggcgatcgattattccatctgtgccagagttgccggtagtcatcaccacggctgcgatataaattcctttttgcgcaagacgagcaagcgatgcgccacagcctaattctatatcgtcaggatgtgcgccaatagcaaggataccctttcttttatttgccgaagaaaggagggctgaatctaaaaccttatccacttaatgacactccattttatttattatactacaagcacaacgatgcactcagagacgtaatctctggcgcagccagatgttaatttataaatgttaaatgttgctaataactgaaaagcaagggctttcagacccgtgggttcgactgggtaatgtttctatgcaattcatatgttaagtgtttgtatgtttggtatgtatagttattttgttttatacattgtatttagatgtgatttagtttgtcaattaattgcatttaaaaaatatgttctgtgaacaagcattgtttatatacattatgtgaatgtaatatgcgagtgattgagaatgatacagtgatatatacaatgcgaatataatagttttattatatgtattgatattgatagaaataatgaagtaataaatctcgtaatgtggttgtttatgcatcactaaaatgaagtgtagtaattttcccaattgttagaacggagtaattgcatatttaatctttccttagccgtttttttgctaagaataaaatcatctgtgcgataacgactaattcttttaatgaatgtttttattcctgaatactgctcccataacaagacaggggagcagacaatcatggcaatttcatcgcgtaacacacttcttgccgcactggcattcatcgcttttcaggcacaggcggtgaacgtcaccgtggcgtatcaaacctcagccgaaccggcgaaagtggctcaggccgacaacacctttgctaaagaaagcggagcaaccgtggactggcgtaagtttgacagcggagccagcatcgtgcgggcgctggcttcaggcgacgtgcaaatcggcaacctcggttccagcccgttagcggttgcagccagccaacaggtgccgattgaagtcttcttgctggcgtcaaaactgggtaactccgaagcgctggtggtaaagaaaactatcagcaaaccggaagatctgattggcaaacgcatcgccgtaccgtttatctccaccacccactacagcctgctggcggcactgaaacactggggcattaaacccgggcaagtggagattgtgaacctgcagccgcccgcgattatcgctgcctggcagcggggagatattgatggtgcttatgtctgggcaccggcggttaacgccctggaaaaagacggcaaggtgttgaccgattctgaacaggtcgggcagtggggcgcgccaacgctggacgtctgggtggtgcgcaaagattttgccgagaaacatcctgaggtcgtgaaagcgttcgctaaaagcgccatcgatgctcagcaaccgtacattgctaacccagacgtgtggctgaaacagccggaaaacatcagcaaactggcgcgtttaagcggcgtgcctgaaggtgacgttccggggctggtgaaggggaatacctatctgacgccgcagcaacaaacggcagaactgaccggaccggtgaacaaagcgatcatcgacaccgcgcagtttttgaaagagcagggcaaggtcccggctgtagcgaatgattacagccagtacgttacctcgcgcttcgtgcaataaaaggaggcgcagatgctgcaaatctctcatctttacgccgattatggcggcaaaccggcactggaagatatcaacctgacgctggaaagcggcgagctactggtggtgctggggccgtccggctgcggtaaaaccaccctgctgaatctgattgccggttttgtgccttatcagcatggcagcattcaactggcgggtaagcgtattgagggaccgggagcagagcgtggcgtagtttttcagaatgaagggctactaccgtggcgcaatgtacaggacaacgtggcgttcggcctgcaattggcaggtatagagaaaatgcagcgactggaaatcgcgcaccagatgctgaaaaaagtggggctggaaggcgcagaaaaacgctacatctggcagctttccggtggtcaacgtcagcgggtggggattgctcgtgcgctggcggcgaatccccagctgttattactcgacgaaccgtttggtgcgctggacgccttcacccgcgaccagatgcaaaccctgctgctgaaactctggcaggagacgggcaagcaggtgctgttgattacccacgatatagaagaagcggtgtttatggcgactgaactggttctgctttcatccggccctggccgtgtgctggagcggctgccgctcaactttgctcgccgctttgttgcgggagagtcgagccgcagcatcaagtccgatccacaattcatcgccatgcgcgaatatgttttaagccgcgtatttgagcaacgggaggcgttctcatgagtgtgctcattaatgaaaaactgcattcgcggcggctgaaatggcgctggccgctctcgcgtcaggtgaccttaagcattggcacgttagcggttttactcaccgtatggtggacggtggcgacgctgcaactgattagcccgctatttttgccgccgccgcaacaggtactggaaaaactactcaccattgccggaccgcaaggctttatggacgccacgctgtggcagcatctggcagccagtctgacgcgcattatgctggcgctatttgcagcggtgttgttcggtattccggtcgggatcgcgatgggacttagccctacggtacgcggcattctggatccgataatcgagctttatcgtccggtgccgccgctggcttatttgccgctgatggtgatctggtttggtattggtgaaacctcgaagatcttactgatctatttagcgatttttgcaccggtggcgatgtcggcgctggcgggggtgaaaagcgtgcagcaggttcgcattcgtgccgcccagtcgctgggtgccagccgtgcgcaggtgctgtggtttgtcattttgcccggtgcgctgccggaaatcctcaccggattacgtattggtctgggggtgggctggtctacgctggtggcggcggagctgattgccgcgacgcgcggtttaggatttatggttcagtcagcgggtgaatttctcgcaactgacgtggtgctggcggggatcgcggtgattgcgattatcgcctttcttttagaactgggtctgcgcgcgttacagcgccgcctgacgccctggcatggagaagtacaatgagtgaacgtctgagcattaccccgctggggccgtatatcggcgcacaaatttcgggtgccgacctgacgcgcccgttaagcgataatcagtttgaacagctttaccatgcggtgctgcgccatcaggtggtgtttctacgcgatcaagctattacgccgcagcagcaacgcgcgctggcccagcgttttggcgaattgcatattcaccctgtttacccgcatgccgaaggggttgacgagatcatcgtgctggatacccataacgataatccgccagataacgacaactggcataccgatgtgacatttattgaaacgccacccgcaggggcgattctggcagctaaagagttaccttcgaccggcggtgatacgctctggaccagcggtattgcggcctatgaggcgctctctgttcccttccgccagctgctgagtgggctgcgtgcggagcatgatttccgtaaatcgttcccggaatacaaataccgcaaaaccgaggaggaacatcaacgctggcgcgaggcggtcgcgaaaaacccgccgttgctacatccggtggtgcgaacgcatccggtgagcggtaaacaggcgctgtttgtgaatgaaggctttactacgcgaattgttgatgtgagcgagaaagagagcgaagccttgttaagttttttgtttgcccatatcaccaaaccggagtttcaggtgcgctggcgctggcaaccaaatgatattgcgatttgggataaccgcgtgacccagcactatgccaatgccgattacctgccacagcgacggataatgcatcgggcgacgatccttggggataaaccgttttatcgggcggggtaatacgagagtggacggtcccctcgcccccttggggagagggttagggtgagggggcgttcaccgtactttcaacaggttaactccccctttctgagaggaaacaaaattaacgcagaatcttcttctcagccaaatccagcgcaaagtagctgaaaatcagatccgcacccgcacgcttaatcgaacctaagctttcgagcacgactttctcttcatctatagcacccgccagcgcggcgaacttaatcatcgcatactcaccgctcacctgatacgcgccaatcggcaattcagtacgttcacgcagctcacgcacgatgtcgaggtacgctccagcaggtttaaccatcaggcagtctgcgccctgggcttcatccagcagtgattcacgaatcgcctcacgacggttcattgggttcatctgatagcttttgcggtcgccttttaatgcgcttccggcagcttcacggaacgggccataaaaggaggaggcgaacttggtcgaatacgacataatcgccgtatctttaaatcccgcagcgtccagcgcctgacgaatcgcctgtacctggccgtccatcgcggcggaaggggcgatgaagtctgcacctgcagcagctgcaaccacggcttgcttgcctaaattttccagagtcgcgtcgttgtcgacgccatgctcgcacagcacaccgcagtgaccgtgagaagtgtattcacagaagcaggtgtctgacataacgatcatttctggcacggtctgcttgcagatgcgcgacatacgcgccaccagtccatcttcccgccaggcatcgctgccggtttcatcggtatggtgagagatgccaaaagtcatcacggaacgaataccggcgttggcgatgcgttcaatttcgcgtgccagatgtttctctggaatgcgcatcacgcctggcatggcttcaacggctttgtagtcgtcaatttcttcttcaacaaagatcggcaacaccaggtcgttaaggctaagtgttgtctcttcaaacatagcgcgcagcgcaggagatttgcgcaggcgacgagggcgttggattaagtctgtcatggtctgcctgatgtttgtggaatcgaggggcatagtatacctgaagcagggtagggatgttttacgaaagttgtcgcgatgttgacaagaagagaatggaagagaggccaggacatctttttaatagaaacagcaataattttatattcactgaaaatatttttaatctttatttatagctgttggttattattttttggagtttggttgcgctgctataaattgaataattaaaactttgttgcatattcataggatatttatctggtttgtgtttgtgatatttattatgcgtatgcttcaaaaacaaaattatctgcaacatgttgaaatactgtgcttttatgaatttgatgcgtgtttttctccataaattatatatgtccacattcggacttaggggaaagaataattgaaccattcgtctgtaacgcagcataatcgttagcgcgaaacataatatgttttctatgcattgataattgatggatcaacttattacgtccctgaggagggatgacaaatgcactcctggaaaaagaaacttgtagtatcacaattagcattggcttgcactctggctatcacctctcaggctaatgcagcaaactatgatacctggacttatatcgataatcccgttacagcacttgattgggatcatatggataaggcaggcactgtagatggcaactatgtaaactatagtggttttgtctattacaacaacaccaatggtgatttcgatcagtcctttaacggcgataccgttaacggcacgatctcaacctattatttgaaccatgattatgcagacagtactgctaatcagcttgatatcagtaattcagtgattcacggttcgattacttctatgctgcctggcggttattatgatcgttttgatgcagatggtaataatctgggtggatatgatttttacactgatgcggttgttgatacacactggcgtgatggtgatgttttcactttgaacattgctaacactactattgatgatgattatgaagctctttacttcactgattcttataaagatggtgatgtaaccaagcacacaaatgagacatttgatacaagtgaaggcgttgctgttaatcttgatgtagaaagtaacatcaatatttccaataactcccgcgttgcaggtattgcattatctcaaggtaatacttacaacgaaacctacactaccgaatctcatacttgggataacaatatctctgtaaaagattccacagtgacttcgggttcaaattatatcctggatagcaatacttatggcaaaactggtcactttggcaattctgatgaaccgagtgattatgctggcccgggtgatgttgcaatgtcctttactgcttcaggttccgactatgcgatgaagaacaatgtattcctcagcaattcaacgctgatgggtgatgttgcctttaccagcacctggaatagtaattttgatccgaatggtcatgattccaacggtgacggggtgaaagataccaacgggggttggactgatgatagcctcaacgttgatgaactaaatctcactctcgataacggaagcaagtgggttggtcaggcaatttataacgttgctgaaacgtcagcaatgtatgatgttgctacaaacagccttactcctgatgcaacatatgaaaacaatgactggaaacgtgttgttgatgacaaggtcttccagagcggtgtatttaacgtagcgttgaataacggttctgaatgggatactacaggtcgttccatcgttgataccttgacagttaataatggttctcaggttaatgtttcggaatctaaattaacttcagatactatcgatttaactaacggttcttcgctgaacattggtgaagatggctacgttgataccgatcatctgactattaactcctacagtactgttgcgttgaccgaatctactgggtggggggctgattgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgaccacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagattacaacctgtacgccaatactatcaccgtaactaacggcggtgtattggatgtgaacgttgatcagttcgatactgaagctttccgtactgacaaactggaactgaccagcggcaacatcgctgaccataacggtaacgtagtatctggtgtgttcgatatccatagcagcgattacgttctgaacgctgatctggtgaacgaccgtacctgggatacttccaagtctaactacggttacggtattgttgctatgaactctgatggtcacctgactatcaacggtaacggcgacgtagacaacggtactgaactggataacagctctgtagacaatgttgttgctgcaaccggtaactacaaagttcgtatcgacaacgcaactggcgctggcgctatcgctgattacaaagataaagaaattatctacgtaaacgacgtcaacagcaacgcgaccttctctgctgctaacaaagctgacctgggtgcatacacctatcaggctgaacagcgcggtaacaccgttgttctgcaacagatggagctgaccgactacgctaacatggcgctgagcatcccgtctgcgaacaccaatatctggaacctggaacaagacaccgttggtactcgtctgaccaactctcgtcatggcctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgacatgaatgaccgttctggtcaggtggatcaagacagccagactgcctacatctactcttctgctcacttcgcgaacaacgtctttgttgatggtagcttgagctactctcacttcaacaacgacctgtctgcaaccatgagcaacggtacttacgttgacggtagcaccaactccgacgcttggggcttcggtttgaaagccggttacgacttcaaactgggtgatgctggttacgtgactccttacggcagcgtttctggtctgttccagtctggtgatgactaccagctgagcaacgacatgaaagttgacggtcagtcttacgacagcatgcgttatgaactgggtgtagatgcaggttataccttcacctacagcgaagatcaggctctgactccgtacttcaaactggcttacgtctacgacgactctaacaacgataacgatgtgaacggcgattccatcgataacggtactgaagggtctgcggtacgtgttggtctgggtactcagtttagcttcaccaagaacttcagcgcctataccgatgctaactacctcggtggtggtgacgtagatcaagactggtccgcgaacgtgggtgttaaatatacctggtaatattcttcactccgaagaaatactggtaatttaatctaaataatgcccgtcaaggatttgacgggcattactgcaaaggacgcgcaaatgttatctgtagttaaacctcttcaggaatttggtaagctcgataaatgtttgtccagatacggtacgcgcttcgagtttaataatgaaaagcaagttatattttccagtgatgtcaataacgaagatactttcgttattttagagggagttatctctctgcgtagagaagaaaacgtacttatcggtattacccaggctccttatattatggggctggctgatggtttaatgaaaaacgatataccatacaaattaatatcagaaggaaattgtacgggatatcatctaccagccaaacaaaccattacgcttattgaacaaaatcaactctggcgagacgctttttactggttagcctggcaaaatagaattctggaattacgcgacgtgcagctcattgggcataattcctacgaacaaatccgcgcaacattattatcaatgattgactggaatgaagaattgcgatcacgtattggtgtgatgaattatatccatcaacgtacacgcatatcgcgttctgtcgtcgcagaagttctcgctgctttgcgtaaaggcggctatatcgaaatgaataaaggcaaactggtcgctatcaaccgtttgccttcagagtattaatcaggacgcggggataaccaacggtttattcccgcttagctcggtcaccaggtcattgatgccatcgctcatatttttaaagcgcgtcaacggcgaacgagtgaccaccacaaacgcgccaatattcttctgcgggatcatcgccatataggtaatgaaaccgccaccaccgcctgtcttctgaataatccccggacgaccctctttcggggccatatatacccaacctaaaccaagcgcatccgctttgccggggacatccatgccaatcactttcgtaaactgcgcgcgctgataaatcaacgtctgcatgcgatctgcctggttactgcgctgataaaaatcagatgacaaatactgctgcatccagcgcatcatatcgccaggcgtggaatagacgccgccgctgccaattgccgccagcgtgttattgcacggactggcaccgcgctcagcaaccattaaacggcggcactgatccggtgagggggtgtaggtggtgtctttcatccccaatggacgggtaatctgctcttcaaacaactgggtataaggcttgccggacgcattcgccagtgcatctgccagcaggtcgaacgcaaggttagagtacgccgcctgactgcctggcgcggctttcagcttcgccgtagaaaggtatttccagcgttgctcgcgcgttggccagacaaacaccggacgatgtgccgcgccaccgggctgttcacggggcagggcgctggtatgggttgccagattgaccagcgtaatgggcgtcccattgtaggttggcacgcgtgcgcctggcggagcatatttacttagcggatcgtttaacttcacggtcccctggtcgagcaatttcaccagcatctcactggtcattagcttggtgagggaagcaatacgcacgaccgaatccagctgcgggcgaacgttattaccaggtcgcgtttcgccataactgcgaaagacgcgctggttaccgtcgataacaaccagagccatccccgtggcaccgctgccgtaaaaaatatgatcggcataacgatcgacaatatcagaggcaaactccggttcagtgatcggctgcgccgcatggacggaggtcaatgacgccgcacacagcacggcagaaaaaagcagactacgtttcaacggtggtgtccatagattgaatgaaggtaactgagcgtatttatactactcattgatagattgcaaagggcgaattagtgcaataatagtgttaaaaacgtaacggcgcgtaaacacgatctttttcctgctcaccaatgcctgcatttgtgatcctgcgcgtgttaatccgcttatgtaaacaatctttggtttgtgaaatccgtcgaaacaattcttatggtcaggctggcgaactaagcgccttgctatgggtcacaatgggcggtttcatttggctgacgctttgtagcggtcatgcggttaatacacagcagttgttaaaacgataagaagttagcaggagtgcatatgtttaagtcttttttcccaaagccgggaacgttttttctctcggccttcgtttgggcattgattgccgttatcttctggcaagccggtgggggtgactgggtggcgcgtatcaccggcgcttccgggcagatcccgattagcgccgcgcgtttctggtcgttggatttcctgattttttacgcttactacattgtttgcgtaggactttttgcattgttctggtttatctacagcccgcatcgttggcaatactggtcaatactcggtactgcactgatcatcttcgtcacctggtttttggtggaagtcggggtcgccgtcaacgcctggtatgcgccgttctatgatctgattcaaaccgcgctaagttcgccgcataaagtcaccatcgaacaattttaccgcgaagtgggcgtctttctggggattgcgctgatcgctgtggtgatcagtgtgctgaacaacttctttgtcagtcactacgtgttccgctggcgtacagcgatgaacgaatattacatggcgaactggcaacaactgcgtcatatcgaaggggccgcacagcgtgtgcaggaagacaccatgcgttttgcttcaacgctggagaatatgggcgtcagttttatcaacgccatcatgacgttgatcgccttcctgccggtgctggtaacgctctccgcgcatgtgccggagctgccgattatcgggcacattccgtatggtctggtgattgccgcaatcgtctggtcgctgatggggaccggattgctggcagtggtagggatcaaactgccggggctggagtttaaaaaccagcgtgtagaggctgcctaccgtaaagagctggtttatggtgaagacgatgccacgcgcgcgacgccgcctacggtacgcgagctgtttagcgccgtacggaaaaactatttccgcctctattttcactatatgtatttcaacatcgcccgcattctctatttgcaggtcgataacgttttcggtttgttcttgctgtttccgtcaattgttgccggtacgattacgctcggcctgatgacgcagattaccaacgtttttggtcaggttcgcggtgctttccagtacctgattaactcatggaccacactggttgagttgatgtctatctacaaacgtctgcgcagctttgaacatgagctggatggtgacaaaattcaggaagtaacccataccttgagctaaaaaggagaagtaatgtcgcgcgtcaatcctctatcttcgctgtcattgttggcggttctggttttagcggggtgtagtagtcaggctccgcaaccgttgaaaaagggcgaaaaagcgatagatgtagcgagcgtcgtgcggcagaagatgcctgcgagcgtgaaagaccgcgatgcctgggcgaaagatctcgccaccacctttgaaagtcaggggctggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggttcataccgcgctaaaaatcaaatcgccaaacggcaaaagttatagcgaacggttagattcggtgcgtacagaaaagcaattgagcgcgatttttgacgatctgatcaacatggtgccaatggggcagacgctgtttggttcgctcaatccggtgcgcaccggtgggccgatgcaggtcagcattgcttttgccgaacagcataccaaagggtatccgtggaaaatggacggtacagtccgtcaggaagtcttcagtcgccgcggcgggttgtggtttggtacttaccatttactgaattatcccgccagttatagcgcaccgatataccgttttgctgattttaacgctggctggtacgccagccgtaatgccgcgtttcagaacgcggtcagtaaggccagcggcgtgaagctggcactggacggtgatttaattcgttacgacagtaaagaacccgggaaaaccgaactggcaacgcgcaaactggctgcaaaactggggatgagcgacagcgaaattcgccgtcagttagagaaaggtgacagcttctcttttgaggagacggcgctgtacaagaaagtttatcaacttgccgaaacgaaaacgggtaaatcactcccccgcgaaatgttgcctggcattcaactggaaagcccgaaaatcacccgcaacctgactacggcctggtttgcgaagcgcgtagacgaacggcgggcgcgttgtatgaaacagtgatcaaacaggaatgtcaggccagataaggcgtttcaggccgcatctgacaatgtaaaacttactggcggcgatgtcgccagtgcagccatagcgccaccactgcaaaaatgaggcagcctactaaaaacgggatcagcccgaaaatggtgccgacacctaaaccaatttccacccgtgggcgacctgtttcctggacctgcattaaacgctcatagacgccgggcgcatgcactaacaggttcagcaattgcgccccagcccaaaagcaaaacagcacaaacaacgcataggcaatgttgccaggcgttgaagaggcattgcgatattttccgctaaacagcgattttgacagggtgaaatcagccataaaaacctccggaagtcatctgcttctcttctggtgtgataccagcggcttatggcaagtctgacaggtcatttagattgtcaatatcagaatcatggtaaattgatgttgggaatattcccgaagcgtgaatcttcgttgtgagtcacaaaatggcaaccttaagttaaatttattaacaattacgaaaatgttgtctacaccacagacggttgttgcagaatatgcaaggatgttgtttttcgttaacggagctgccatgaatctgcctgtaaaaatccgccgtgactggcactactatgcgttcgccattggccttatattcattcttaatggcgtggtggggttactgggatttgaagcaaaaggttggcagacctatgccgtcggtctggtgacgtgggtgattagtttctggctggcggggttgattattcgtcgtcgcgatgaagaaactgaaaacgcccaataagaatattatcgggcgttaaaatattacattgtggttttcaatgcgttatccgcagcgtgacgctccagcgccagttcaatcaaacgtgtgatcagatcggtgtaacccagaccgctggcttgccacagcttcggatacatactgatattagtgaagccaggcagggtgttgatctcgttgatcaccacttcgttctctggggttaaaaacacgtctacacgcgccatgcctgcgcatcccaacgtttgataagcctgaacggcaatcgcccggatcttatcgttgatttctggcgcaatggctgccggaactaccactttcgcgccatcttcgtcaatgtacttggtgtcgtaggcatagaaatcgctggtgagtacgatctctccacaggtgctggcttgcggattgtcgttgcccagaactgcgcattcgatctcacgacctttgatcccttgctcaacgatcactttatgatcgaactcgaacgccagatcgacggcaattgcgtactgttcttcactggttactttgctgacaccaacagaagagccctgattagccggttttacaaacagtggtaaccccagtttagactccacttcggcaaaactaatgttgtgacgattggcgcgcgtcagggtaataaatggcgcaatgttcagcccggcatcgcgtagcagacgtttggtgacatctttgtccatacaggctgctgaagccagaacatcagaacctacaaacggtaaattggcgacccgcagcattccctgcaaggaaccatcttcgcccagcgtaccgtggacaatcgggaaaatgacatccaccgtcggcaacggctgaccgttttgcgcgtcgataagctgatgctcatgtttacctggcacctgcgcaaggctggtcgccgaagggcgcaacgcaatatgggcaggatcgtctgcatttagcagataattgctggcatcgctgacgtgccattgcccttgtttatcaatgcccagcagcacaacgtcgaagcgacttttatcaatggcatcgacaatgttttttgccgattgcagagacacttcatgttccgctgatttaccaccaaaaacgattcctacccgcagtttttccatcttaaaaacctatcccgtctaacacaaagtgcatacattaccacgacaaaacgggggattcgcggccttctgaaagattgttgcaatcttctgctgacaaagcgtgcaacgtactggtgaagaaagtgcgttatctcaaagatgtgcgcaagatcacaaaaatgatgaacgggaagctaatttattcctggcttaaatggccatgcggtgagtttttttctcttaattataagttaacgaagagaatatatttcataacttttatttataataaaggttgataattaaaagcctatattttgtgtgggtaattatttaaataagagaaacgtttcgctggtaatcaaacaaaaaatatttgcgcaaagtatttcctttgtcataaaaataatacttccagacactatgaagttgtgaaacataatgttaacttctccatactttggataaggaaatacagacatgaaaaatctcattgctgagttgttatttaagcttgcccaaaaagaagaagagtcgaaagaactgtgtgcgcaggtagaagctttggagattatcgtcactgcaatgcttcgcaatatggcgcaaaatgaccaacagcggttgattgatcaggtagagggggcgctgtacgaggtaaagcccgatgccagcattcctgacgacgatacggagctgctgcgcgattacgtaaagaagttattgaagcatcctcgtcagtaaaaagttaatcttttcaacagctgtcataaagttgtcacggccgagacttatagtcgctttgtttttattttttaatgtatttgtacatggagaaaataaagtgaaacaaagcactattgcactggcactcttaccgttactgtttacccctgtgacaaaagcccggacaccagaaatgcctgttctggaaaaccgggctgctcagggcgatattactgcacccggcggtgctcgccgtttaacgggtgatcagactgccgctctgcgtgattctcttagcgataaacctgcaaaaaatattattttgctgattggcgatgggatgggggactcggaaattactgccgcacgtaattatgccgaaggtgcgggcggcttttttaaaggtatagatgccttaccgcttaccgggcaatacactcactatgcgctgaataaaaaaaccggcaaaccggactacgtcaccgactcggctgcatcagcaaccgcctggtcaaccggtgtcaaaacctataacggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcacatgtgacctcgcgcaaatgctacggtccgagcgcgaccagtgaaaaatgtccgggtaacgctctggaaaaaggcggaaaaggatcgattaccgaacagctgcttaacgctcgtgccgacgttacgcttggcggcggcgcaaaaacctttgctgaaacggcaaccgctggtgaatggcagggaaaaacgctgcgtgaacaggcacaggcgcgtggttatcagttggtgagcgatgctgcctcactgaattcggtgacggaagcgaatcagcaaaaacccctgcttggcctgtttgctgacggcaatatgccagtgcgctggctaggaccgaaagcaacgtaccatggcaatatcgataagcccgcagtcacctgtacgccaaatccgcaacgtaatgacagtgtaccaaccctggcgcagatgaccgacaaagccattgaattgttgagtaaaaatgagaaaggctttttcctgcaagttgaaggtgcgtcaatcgataaacaggatcatgctgcgaatccttgtgggcaaattggcgagacggtcgatctcgatgaagccgtacaacgggcgctggaattcgctaaaaaggagggtaacacgctggtcatagtcaccgctgatcacgcccacgccagccagattgttgcgccggataccaaagctccgggcctcacccaggcgctaaataccaaagatggcgcagtgatggtgatgagttacgggaactccgaagaggattcacaagaacataccggcagtcagttgcgtattgcggcgtatggcccgcatgccgccaatgttgttggactgaccgaccagaccgatctcttctacaccatgaaagccgctctggggctgaaataaaaccgcgcccggcagtgaattttcgctgccgggtggtttttttgctgttagcaaccagacttaatggcagatcacgggcgcatacgctcatggttaaaacatgaagagggatggtgctatgaaaataacattactggttaccttgcttttcggtctggtttttttaaccaccgtcggcgctgccgagagaactttaaccccacaacaacagcgtatgacctcctgtaatcagcaggcgacggcgcaggcgttgaaaggggatgctcgtaagacctacatgagtgattgcctgaagaacagcaagtctgcgcctggcgaaaaaagtttgacgccacagcagcaaaagatgcgcgaatgcaataatcaagcaacacaacaatctctgaaaggtgatgatcgtaataagtttatgagtgcctgcctcaagaaagccgcctgatacctgatagtgctaacgggtgagctacgaaaatggctcacccgaaatatcatacttctgcctttagctccgtctctataatttgggaaaattgtttctgaatgttcccaaaaataatgaatgatgaaaactttttcaaaaaagcggcggcgcacggggaggaacctcctttaactcctcaaaacgaacatcagcggtccgggctgcgcttcgcccgtcgcgtcagactaccccgtgcggttggcctggctggcatgttcttaccgattgcttcaacgctggtttcacacccgccgccgggctggtggtggctggtgttggtcggctgggcgttcgtctggccgcatttagcctggcagatagcgagcagggccgtcgatccgcttagccgggaaatttacaacttaaaaaccgatgcagtattagcgggaatgtgggtaggcgtaatgggcgtaaacgtgctgccttccaccgcgatgttgatgattatgtgtctgaatttgatgggggcaggcggcccccgtctgtttgtcgcgggtctggtgttgatggtggtttcctgccttgtcaccctcgagctgacgggcattaccgtgtcgttcaatagtgcgccgctggaatggtggctctcccttcccattattgtcatttatcctctgctgtttggctgggtcagctaccagacggcaaccaaactggcggaacataaacgcaggttgcaggtcatgagtacccgcgacggcatgacgggcgtgtataaccgacgtcattgggaaactatgttacgcaatgaatttgataactgtcggcggcataatcgcgatgcaacgttactgattatcgatatcgaccatttcaagagcatcaacgatacctggggccatgatgtgggcgatgaagcgattgtggcgcttacccgacagttacaaattaccctgcgcggtagcgatgtgattggtcggtttggcggcgatgagtttgcagtaatcatgtccggtacgccagctgagagcgccattaccgccatgttacgggtgcatgaagggctaaatacattacgtttgccgaatacgccacaggtaactttacggattagtgtgggggttgcgccgctgaacccacaaatgagtcactatcgtgagtggttgaaatcggcagatttggcgctttacaaagcaaagaaagccggacgtaaccgcaccgaagtggcggcctgacgtccggcgaaagtcatcaggatttgctgagtttttctgatttttccatacacttcgtcatcgcttcgatcactgcagcacggaagcctttctcttccagtacgcgtaccgcttcaatggtggtgcctcccggtgagcagaccatatctttcagtgcccccggatgttctcccgtttccagcaccatttttgcggaacccattaccgcctgagcggcaaatttatacgcctgggcgcgtggcatcccgcccagcacggcggcgtcggccatcgcttcgataaacataaatacgtaggctggcgaagaaccgctcacaccgaccaccgggtggatcatcggctcagcaattacttccgcttcgccaaagcagcggaaaatattcagcacatcagcggtatcttctggggttaccagcgcgtttggcgttacggaggtcatcccggcattaaccagtgcgggagtgttcggcatggcgcggataattttccggtcatggcccagcgcgcgggcaagctggtcgagcgtgacacctgcagcaatagaaacgaccagagagtctttattcaggctggaggtgatttcgctaagcactttaatcatgatgccaggtttaacggcagcaaaaatgatgtcggcgatttgcgccacttcttgcgccgattctgcggcgttgatgccgaactggtcatgcagggcggcgactttatccggggagggggtgtatacccagatttgccctggaagcacctgaccgctggcaatcagaccgccgagaatggcttttcccatattgccgcagccaataaaaccgattttcttttccattgcctcactcctgccgtgaaattcattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggcggaacgtatgcagatgccgctggtactggtagcaaaccagagtttacgcgtgccgccatcgcgatttattcgtacgctgcgcgtcgcggcaggtttcgacgttgccgataacgaaattgtccggcagtgtgaagcgggcgatttggtgatcaccgcagatatacctttggctgctgaagccatcgagaaaggcgctgcggcgcttaatccgcgcggcgaacgttacacgccagcgaccattcgtgagcgcctgacgatgcgcgattttatggataccttacgtgccagtgggatccagaccggcggaccagatagcctttcacaacgtgaccgccaggcctttgccgcggagctggagaagtggtggctggaagtgcaacgtagtcgtggctaaatgtaatttattatttacacttcattcttgaatatttattggtatagtaaggggtgtattgagattttcactttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgcagcgccctggcacagacgatcaattgttgattttcgagcgcctatacttaacgttcatcccgtgaaataaggaagaacgatgccaacgaaaccgccttatcctcgtgaagcatatatagtgacgattgaaaaaggaaagccaggacagacggtaacctggtaccaactcagagccgatcatcctaaaccagactcgttgatcagtgaacatccgaccgctcaggaagcgatggatgcgaaaaaacgctatgaggaccctgacaaagagtgaccgcatcagactgctcggaagggattctgagtgccactacaagggatctgcgtcacatttttcataattcatgtttttctaataattagaatattaaacaataacaatccattactggaatcatttggaatctttacattatgccgtgcacgtctgctgctacgctttttgtcatttgtagcacaagtaagtgtcagcagtggtgcttcacacttgcccggtaattaacgacgaaagaaaagtaaggtggatgaacaatgagtgcgtcgttggcgatcctgaccatcggcattgtacctatgcaggaagttttgccgctcctgacggaatacattgacgaagataatatttcccatcatagcctgctggggaagttaagtcgtgaagaagtgatggcggagtacgcgccagaagcaggcgaagacaccattctcacattattaaatgacaaccagctggcccatgtttcgcgtcgcaaagtggagcgtgacctgcaaggtgtggttgaagtgctcgataatcagggttatgacgtcattttattaatgagtacagcaaacattagtagtatgactgcgcgtaatacgatctttcttgagccgtcgcgaatattgcctccactggtttcctctattgttgaagatcatcaggtgggggttatcgttccggttgaggagatgctgcccgttcaggcgcaaaaatggcaaattttgcagaaatcgccggtattttcattgggtaaccccattcatgattcagaacaaaaaatcattgatgccgggaaagaattactggcaaaaggggctgatgtcatcatgctggattgtttaggatttcaccaacgtcatcgcgatttactgcaaaaacagctcgatgttcctgtcttgctgtctaacgtattgattgcacggctggctgcggaattactggtgtaattttgcgtgacagccagcgcctctggcccctatagtgaagtagatgttcaactaccaaacagggccagtttatgcttcaaagtaatgagtacttttccggcaaagtgaaatcaatcggcttttccagcagcagcactggtcgcgccagcgtgggtgttatggttgaaggcgaatacaccttcagcaccgctgagccggaagagatgacggtaatcagtggcgcgctgaatgtgttactgcctgacgcgaccgactggcaggtgtatgaagccggttcggtgtttaatgttcccggtcacagtgagtttcatctgcaagttgccgaacccacctcttatctgtgccgctatctgtaattcctcgccttccccttgaacgggagggcatttttctgaaatatcctttctttagcccataataatatttcctttgctgcgattttttcaatttccgatatattcataatttatcaaggttgatataaatatcagtgaagatctccagatattgttgcggaactggctacgataaaagataaatcagatgatgaatggtggcgtgcattgctgcaaagtcgcaatgatcatttacgccaaacggcattgcgcaacgcacataccccggcgttgttgttaacgacattgactgagcctcaggatcggtcgctggctattaataatccacagctggctgccgatgtgaaaacggcgtggttaaaagaggatccatcattactcttatttgtcgaacaacccgatctttcgctgttacgtgatttagtgaaaaccggggcaacgcggaaaattcgcagtgaagcgcgtcaccggcttgaggaaaaacaatgacacaacgtccatggagcaagttacagcgtaaaacgcataatattgctgcgctaaaaattattgctcgccgtagcgaataattatatgcctggtgtggcttcgtacgccggataagacgcggcaggcgtcgcatccggcattaaaggaaaatcagcaattaacgttgtgcttcgccacctaatccttcaatcaggttttgaattaacgctgccagttcaccagtcatcaggatgaaatcggcatcaaaacgctgggcgaaatcttcacggtcgatatcttcgttttgatcgcgcagctcgtcgcagaacttcagacgcttgagcgaaccatcgtcgcacatcacaaactgaatgcgctgctgccagtcgagcgccagtttagtcaccacttttccggcttcaatgtgattggtgatctcttcgctggtcagatcttgtttcttcgcgcggatcacgccgccatcttccagcaacgatttcagctcggcttcatcaagcagctggaagccctgtgccgcactaccggagcgaacccattcggtcagcgtcagttcaatcgggttttccatgctcaatggtacaaccggtaacgaccccaggcttttacgcagtaatgccagcgtatcttccgcttttttggcactggcgcagtccaccataatcaaaccgttaaccgtgtcgatccacatcattgtctggctaaaacggctgaaagcacgcggcagcagagagtgcagcacttcgtctttcagcgaatctttttcggttttcttcagcttacgcgcctgttccgcttccagtttggcgattttcgcttccagcgcctgtttaatcaccggagacgggaggattttttcttctttgcgcgcgcagataacaatttgaccattggcaacgtgcgttaacgcatcgctgtgcgatcccatcggaggaacccagcccatcttcgccatgtcctggctgccgcatggggtaaatgccatcgaggctagctgtttttccatctcttctgcacgcagcgaaatctcgcggctaagacggtaaaccattaaatttttgaaccacagcatgataatttccacggccttgtcgttaaatttagcgggcatgataacgaattgtcggcggccttgcattgccaatccggttgtccgtctctacgctattgatattgaaaaaaataaggagagtaccgtgcgtataggtatcgatttaggcggcaccaaaactgaagtgattgcactgggcgatgcaggggagcagttgtaccgccatcgtctgcccacgccgcgtgatgattaccggcagactattgaaacgatcgccacgttggttgatatggcggagcaggcgacggggcagcgcggaacggtaggtatgggcattcctggctcaatttcgccttacaccggtgtggtgaagaatgccaattcaacctggctcaacggtcagccattcgataaagacttaagcgcgaggttgcagcgggaagtgcggctggcaaatgacgctaactgtctggcggtttcagaagcagtagatggcgcggcagcgggagcgcagacggtatttgccgtgattatcggcacgggatgcggcgcgggcgtggcattcaatgggcgggcgcatatcggcggcaatggcacggcaggtgagtggggacacaatccgctaccgtggatggacgaagacgaactgcgttatcgcgaggaagtcccttgttattgcggtaaacaaggttgtattgaaacctttatttcgggcacgggattcgcgatggattatcgtcgtttgagcggacatgcgctgaaaggcagtgaaattatccgcctggttgaagaaagcgatccggtagcggaactggcattgcgtcgctacgagctgcggctggcaaaatcgctggcacatgtcgtgaatattctcgatccggatgtgattgtcctggggggcgggatgagcaatgtagaccgtttatatcaaacggttgggcagttgattaaacaatttgtcttcggcggcgaatgtgaaacgccggtgcgtaaggcgaagcacggtgattccagcggcgtacgcggcgctgcgtggttatggccacaagagtaaaaaacgtaggcaattggcgcatcatgcctgatgcgacgcttgccgcgtcttatcaggcctacaaaaggtgccagaaccgtaggccggataaggcgttcacgccgcatccggcaataagtgctccgatgcctgatgcgacgcttgccgcgtcttatcaggcctgcaaaatgtgccagaaccgcgtagggcggataaggcgttcacgccgcatccggcaataagtaatgagcaccgagactataacctaccccagtggtttcgccagcaccggagtatccgccgcttgctggcgcttatagcgaccatacagcagcaacgacgacatcgcagcaaacgaaagcagggcggcaggcagcgccacgtaattatatgccagccccagcgtcagcatcatacctccgcaatatgcgccgacggcgctaccgaggttaaacgctatttgcccacctgcggcacctaataactctccgcctttggcgttttgtagtaacaatatttgtagcggtgctgaaagggcaaataatcccgcgcaacaaataaaagcaaaaataagcgacgttgttttcatgccgccgcagaaaaagagcatcagcagtgccagtacaattataaagtcagtcactgctgcaatgcgcagtggtgaataacgtcctgaaatcctgccacttagcatatttcccagcaccatccctagcccaactaacatcataataaaggtcatcgccgtttccgaaaaaccggaaataaacatcatgtatggctttacgtagctgaaccaggcaaacacacctgcgttgccaaacatcgtggcggcgaaaattaaccacggggccgggctgcgcaaaaagtgaaattgttcgcgcagatttcctttcgcctcgtcgcgaatatctggcacccaaaaatagaccgatgccatcaccgcaatattaaaaacagcgatcaataaaaaggtgtaacgccagctaaattcctgacttaaatacgttcccagcggaatgcccagcaaattggcgactgtcatcccggaaaccatccccgccacggcggcggtgacttttccgggtttgataatttttgataacacgatcgctccgacgccaaaaaatgcgccatgcggaaagccggataccagccgaccaatggcgagcatcaggtaagacgaagagagcgtgaacatggcgttgccaatgacgcacaacgccaccagaaacaacaagatatgtttgagtgagtagcggctggaaaagagtgcgatgattggcgcaccgaccaccacccccagtgcataatacgagatcatatgcccggcggcaggaatcgaaattcctacgttatgcgccagctccgtgagcacgcccataatgccaaattcggccatccccaaaccaaacgtgcccagagccaaagataaaatgacttttttcataccaccatcacaaccaccagaacggctaccaatcaccgtagccaataaagtgatagcttgcaggataacgaccagcaaggccaagagataattcgcccctctgtattcattatcctgctgaatagttatttcactgcaaacgtactttccagtttgctgtagcccaggccgttgatctttttcactttgatctgcaccggaatacgctctttcatcgcttctacgtggctaatcacaccgatggttttgccactggcgttcagggcatccagcgcatcaagggcggtatccagcgtttcgctatccagcgtgccaaaaccttcatcaaggaacagcgagtcaatacgtgttttatggctgaccagatccgaaagcgccagcgccagcgccagactaacgaggaaactttcgccgccggaaagggtacgggtatcgcgtaccgcatctgcctgccaggtatcaacaacctcgacttccagcgcctcgctggctttgcgctgtaacagatagcgcccgtgcagccgggtaagttgctgattagcgagatggactaaattatccagcgtcagcccctgggcaaacttgcggaatttatcgccctctttggaacctattagcgaattcagatatccccagtcctcaacctgctgcgtcatttgagcaatttgctgcattaaggtttgttgttgctgacggttatctgcatcctgcttcagctgctggcgaatctcgccttgactcgtggtgttttcacgcaacttttggtgagtttgcgctaactcttgctgaatctgctccaccgtcacagtgagagccaacccgtcgtcaggtcggtgttgttgatgctgtgccagcgtttctgctgtctgagtgaccagagtttgcgcctgacggcgctggttttccagattctgcttgagctgttccagctgcgttagtgtttgttcatccattagcgccgcaaggaacgcctgctgatcgtcaaagacgctggcctgtagcgcggtgtcaaactgcgcctgggctttttgcagactttgcgccgccagaacatcctgttgctgtaacgtctgctgctggctgtgtaatgcgagacattgttcatgtacctgccgccagttttccaataccacagtttcttcgcagtgcgggagttcatcactttgcggcaacgtttccagaatcggcgtcagctgctgaatacggttttgcagcgcggttaattcgttctggcgttgctgccagctctgcgcttcttgctgacgtgtcgccaaccagctctcttcttcatcttcctgtggcaatgtcagtgcataacccgtcaatgtcgttaaaagtagttgctggcgttgttcaatttgctgttgatactggataatttgctgattatgcgcggcaatctgcccttgtaattcatgccgttggctgagtaaccgcagctggcgttcgtgctcatcttgtgcatccagccacggttgaatatcgtccagtggctgcaaggtgatattgaggctggccgtgacggcttgccattgttgagtaagtgcttgctcatcttgtcggaggctttgcgcttcgttttcatcacgctgaagctgctttgttatggcgtccagttgcccacgtagcgtcgcaccttcttcaccgagctttttaacttcgttttccagcgccagtaatcgagactgattaacgccaggctccagcgcctgatacgcctcgaccgccgggtggctggtggaaccacaaagtgggcaaggctgacccgcctgtaactgtgcacgttgagcttccagcgttttgatgcgcgcttcctgctcgcaaatggttttcacatcggcaagttgctgcgtcttttctttataacgctggcgcatttcgttaagtgcggcgttacgttgcgtctgttcttgcgtgacattctggatagcgacctgtaactgcgccagacgtttttgttggggaacaatctgtccatgcagcgcgaccaggtgctgacgcagtgggcgttgctcagcatgttgcgccagggcggtagcaacttcatcggcggttaacgtcaacgtgatcgccgcaagcgcattaagtttttgctcagcatgggttaactgttgctgccattgccgcagatgctcgcgatcgctggtttgttgggagaactgcgcacgccaacccgccggttcgttgttccactgacggaagcggtcgtgttcctgtaaccaggtattcaggctttgttgctgctgctgtaattctgctgactgcttcgccgcgtggtggcgaatgctcgcgcgaagcgccattgtgctctgtaagcgagtatttacttcttcaatctgctggcgaatatgcgccagcgccgcgctgtgttctgcgatgcgttcccagtgtggacgaagatttcgtgccggttgtgccagactaagcgccgccagttgaggttgcgctttttcttcttcggctaacgcctgttgcaaggcctgctgacggcggctggcttcttgctgcaattcgtcctgacgcgttaaccagtttagcgattgttgttcttgctgctgcgcggtaattaactgtttttcttcgtcagtaagtacctgcaaactcgctgtcagcgattgcacttgttccggcgtgagcaacgtgacgccgctggcctgcgcttgcagcttctccagctctgtgcgggccgatttgtgctgctcaaaaaccatcgccgagatttgcccgtagatttcagtgccggttaactcctcgagcaattccgcgcgttctttgggtttggcattcaggaaggcagcaaattgcccctgcgaaagcagcatcgaacgggtgaagcgcccgtaatccagcccggttaacgtcgctgtcagttccagcttatctttcactttgtcggcgagaattttgccgtcggcgcagcgcgccagctctacgcgtggcacctgcaaattaccgtcgggttggttacgcgcccgattctggctccagaatgcacggtacgcttcacctttcacttcaaactccacctccgccagacattcggcggtatcgcgggtcatgagatcattttgcgattgtgaaacgttagagagacgcggagtttcgtgatacagcgccagacaaatggcgtccagcagggtggttttccccgcacctgttgggccggtaatagcaaacagcccgttgctggcgaacggctcgcgggtgaaatcaatcttccattcgccttttaatgagttcaggtttttcaggcgcaggctgagaattttcatgcttcgtgttctccggcgagggtatgcaacgtcgtggtgaaaagatgctgcagacgttgctgctgcgattcatccagttcttccagtgccagacggcgattgaacacctcttcgacgctgagttcgctgagggtttcacgctgttggctggctaacacacgctcgcgctgttcacgactccgacgtaccagcaatacttcgacaggcaatgattcggttaatgcctggattttgcgctgaatatcatgcagatactcatcagtagtgatttcgatatccagccagacaggtggctcctgcgatacatcgcgccactgttccagctgtgcggtaatcgacgccagatcgcctttcagcactgccatgggttgcgttaccggtacgttcaggttttccacgctctctaatttgccgtttgaaaatgtcaccagatggacatatttactcttaccgcattcatcaaaactcagtggaatgggggagccgcaatagcgaacatgttccatgccgccaataatctgtgcgcggtgaatatgcccgagcgcgatgtagtcggctggtggaaagttttgtgccggaaacgcgtccagcgtgccaatataaatgtcacgcacggcgtcacttttactggcccccacggtcgttaaatgtcccgtggcgatgatgggcagaggctgatcgccgcgcagtttgcaggcatcggcatagtgttgttggtaataatcggtaatcgctgccagtaaatgctgctgtttttcaataccgttaagccccgcctggctggtaataatgtcacgcggacgtaaaaacggaatggggcacagcactgcgcctggcgtcccgtcgcgacgaggcaagatttgcggcgcatgtccggcgctggcgaccacggtagtattgaggaacgccatgatatcgcgcgattcattcagcgtggcgaccgagtcatggtttcctgccagtaccaccagatgacagccagtttgctgtaaattgacaacaaaacggttgtataacgtgcgggcgtaactgggcggcgagccggtatcgaaaacatcaccggcaacaataatcgcatccacctgatgggtttgtgctgtctccagcagccagtcaagaaaagcctgatgttcagcttcgcggcttttactgtagaagttctggccgagatgccagtctgaggtgtgaaggatgcgcataacggttccctggcgaaaaagcatgggcgcgattatacccaaacagatgtgccatttgcttttttctgcgccacggaaatcaataacctgaagatatgtgcgacgagcttttcataaatctgtcataaatctgacgcataatgacgtcgcattaatgatcgcaacctatttattacaacagggcaaatcatggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctcctcgactggatgttacctggcggctccggtatccagttcatcaaacacctcaagcgcgagtcgatgacccgggatattccagtggtgatgttgaccgccagaggggaagaagaagatcgcgtgcgcggccttgaaaccggcgcggatgactatatcaccaagccgttttcgccgaaggagctggtggcgcgaatcaaagcggtaatgcgccgtatttcgccaatggcggtggaagaggtgattgagatgcagggattaagtctcgacccgacatctcaccgagtgatggcgggcgaagagccgctggagatggggccgacagaatttaaactgctgcacttttttatgacgcatcctgagcgcgtgtacagccgcgagcagctgttaaaccacgtctggggaactaacgtgtatgtggaagaccgcacggtcgatgtccacattcgtcgcctgcgtaaagcactggagcccggcgggcatgaccgcatggtgcagaccgtgcgcggtacaggatatcgtttttcaacccgcttttaacgccttgctcatcggacgcagagcagggcttatgatttcttaactggagtatcttacgtgctggaacggctgtcgtggaaaaggctggtgctggagctgctactttgctgcctcccggctttcatcctgggtgcattttttggttacctgccctggtttttgctggcatcggtaacaggactgcttatctggcatttctggaatttattgcgcctttcatggtggctgtgggtggatcgcagtatgaccccgccaccggggcgtggtagctgggaaccgctactatacggcttacaccagatgcagctgcgaaataaaaaacgccgccgtgaactgggcaatctgattaaacgctttcgtagcggcgcggagtcgctgcccgacgcggtggtgctgaccacggaagagggcggtattttctggtgtaacggtctggcgcaacaaattcttggtttgcgctggccggaagataacgggcagaacatccttaacctactgcgttacccggagtttacgcaatatctgaaaacgcgtgatttttctcgcccgctcaatctggtgctcaacaccgggcggcatctggaaattcgcgtcatgccttatacccacaaacagttgctgatggtggcgcgtgatgtcacgcaaatgcatcaactggaaggggcgcggcgtaacttttttgccaacgtgagccatgagttacgtacgccattgaccgtgttacagggttacctggagatgatgaatgagcagccgctggaaggcgcggtacgcgaaaaagcgttgcacaccatgcgcgagcagacccagcggatggaaggactggtgaagcaattgctgacgctgtcgaaaatagaagccgcaccgacgcatttgctcaatgaaaaggttgatgtgccgatgatgctgcgcgttgttgagcgcgaggctcagactctgagtcagaaaaaacagacatttacctttgagatagataacggcctcaaggtgtctggcaacgaagatcagctacgcagtgcgatttcgaacctggtctataacgccgtgaatcatacgccggaaggcacgcatatcaccgtacgctggcagcgagtgccgcacggtgccgaatttagcgttgaagataacggaccgggcattgcaccggagcatattccgcgcctgaccgagcgtttttatcgcgttgataaagcgcgttcccggcaaaccggcggtagcggattagggttagcgatcgtgaaacatgctgtgaatcatcacgaaagtcgcctgaatattgagagtacagtaggaaaaggaacacgtttcagttttgttatcccggaacgtttaattgccaaaaacagcgattaatccgcctttgtcatcttttattgccataagccagtcgatgctggcttattttctttgcagtcaaaatacgggcgttagattttacaacgattggtgattttttgttcgcatgattagccatgtctttttcacggaaatagtgttttatactggttggtgatttcttatcgctatatacctctggtttttagatccctccttgctttaaaacgttataagcgtttaaattgcgcttcaggtgctgtcatactgactgcattaacgcggtaaatcgaaaaactattcttcgccgcgcctggttgggagtatttcccgctaaaattgtttaaatataccgctgtatcatccccagggattggcacaaaaatttaacgttacaacaccacatccacaggcagtatgatttatgacccatcaattaagatcgcgcgatatcatcgctctgggctttatgacatttgcgttgttcgtcggcgcaggtaacattattttccctccaatggtcggcttacaggcaggcgaacacgtctggactgcggcattcggcttcctcattactgccgttggcctgccggtattaacggtagtggcgctggcaaaagttggcggcggtgttgacagcctcagcacgccaatcggtaaagtcgctggcgtactgctggcaacggtttgttacctggcggtggggccgcttttcgctacgccgcgtacagctaccgtttcctttgaagtggggattgcgccgctgacgggtgattccgcgctgccgctgtttatctacagcctggtctatttcgctatcgttattctggtttcgctctatccgggcaagctgctggataccgtgggcaacttccttgcgccgctgaaaattatcgcgctggtcatcctgtctgttgccgctattgtctggccggcgggttctatcagcacggcgactgaggcttatcaaaacgctgcgttttctaacggcttcgttaacggctatctgaccatggatacgctgggcgcaatggtgtttggtatcgttattgttaacgcggcgcgttctcgtggcgttaccgaagcgcgtctgctgacccgttataccgtctgggctggcctgatggcgggtgttggtctgactctgctgtacctggcgctgttccgtctggggtcagacagcgcgtcgctggtcgatcagtctgcaaacggcgctgctattctgcatgcttacgttcagcacacctttggcggcggcggtagcttcctgctggcggcgttaatcttcatcgcctgcctggtaacggcagttggcctgacctgtgcttgtgcagaattctttgcccagtacgtaccgctctcttatcgtacgctggtgtttatcctcggcggcttctcgatggtggtttctaacctcggcttaagccagctgatccagatctccgtaccggtgctgaccgctatttatccgccgtgtatcgcactggttgtattaagttttacacgctcatggtggcataattcgtcccgcgtgattgctccgccgatgtttatcagcctgctttttggtattctcgacgggatcaaagcatctgcattcagcgatatcttaccgtcctgggcgcagcgtttaccgctggccgaacaaggtctggcgtggttaatgccaacagtggtgatggtggttctggccattatctgggatcgcgcggcaggtcgtcaggtgacctccagcgctcactaaatcactgaacatttgttttaaccacggggctgcgatgccccgtggttttttattgtgttgatgggttaggaattgatggaaagtaagaacaagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagcgtggtgctgatcatttgcgccgtaaacctgatgagcgtgaaggtattcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgttcgtgctgacgttccagcatatgggcattacctttgccgccagcattcttaactttgttgtgctgactgcttcgctgtcggcaattaacagtgatgtatttggcgtaggccgtatgctccacggtatggcagagcagggcagcgcgccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaattgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccagtaatccttgcgttctgtaagccggttcaggaggaaatcctgatccggctattccgaaagttatccgcccccgtcctcctcccccaaatatccttcagatgatgagtgatcctgcattaggctatggcaaggtgatcagattttcatcacaggggaattatgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcataatcgtggcacgggtggtgcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgccgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccctggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcaacgtgtactggtggcaatcaaccgtggcgaggcctgtgaagtggtgctacccgcgtcaccgtttctcaatgccgtgcaatggcaatgcaaagaagggcatgggcaactgactgacgggattctggctttgcctgccatttcggctacggtatggatgaactaacgttttataacgccttgcgtgacgcctgcgccatcatccgcggataaaactgccagaagcgggtttcgagggcgtcataatgagcgtctaaatcgtaccaggagtcacgcagggcatccagacgtgggcggcggcttgccatgccgtttaacacgttctggatgaaatccatatcgcgatagcgcaccagccactgctctgaccacaagtaattgttcagattgataaaacgtggcggtgagtccggcaaaatcgtcatcacttgctcgcgggcataacagacaaattcctgtagcggaaagtccggcgacagctgcgaccagtggcgggaaagaaagtgatcccacatgacatccagcgtaataggcgcaacgcggcgcgtttcactacgaaaccactcccgtgcttcgcggacttccggcagattgtcagtcaatacgtcgatacgtcgatgcatatgaatgccagccacgacgtcgggcggaaaactttcttcaggatttccgcgtacgaaatcagccagtaaattgccggaaagcgagctttccgcgagatgggctaaatgcaggtgagctaaaaaattcatcgattatattctatccaaaagggggtaaaggttgcagggagagcgccccggcactagactacccgcctcttattttagtctgagtcagtgtcatgcgcgttaccgatttctcctttgaattgcccgaatccctgattgcccactatcccatgcctgaacgcagtagctgtcgtttactgtcgctggacgggccgacgggcgcgctgacgcacggtactttcaccgatttacttgataagctcaaccccggcgatcttctggtttttaataatacccgcgtgatcccggcgcgcctgtttgggcgtaaagccagcggcggcaagattgaagtgctggttgaacggatgctcgacgacaaacgcattcttgcgcatattcgcgcctcgaaagcgccaaaacctggcgcagaactgctgctgggcgatgacgaaagtattaacgcaacaatgaccgcgcgccacggcgcactgtttgaagtcgaatttaatgatgaacgctcggtgctggatattctcaacagcatcggccatatgccgctgccgccgtatatcgaccgtccggacgaagacgctgaccgcgaactttatcaaaccgtttatagcgaaaaaccgggcgcggttgcagccccgaccgcaggtctgcattttgacgagcctttgctggaaaaattgcgcgccaaaggcgtggagatggcgtttgtgacgttgcacgttggtgcgggcaccttccagccggtgcgcgtcgacaccattgaagatcacatcatgcactcggaatacgctgaagtaccgcaggatgtggtagacgcggtactggcggcgaaagcgcgcggtaaccgggtgattgcggttggcaccacttcagtacgttcgctggaaagcgcggctcaggcagcgaaaaacgatctcattgaaccgttcttcgacgatacccaaatctttatctatccgggcttccagtacaaagtggtcgatgcgctggtgacgaacttccacttgccagagtcgacgctgattatgctggtttcggcctttgccggttatcaacacaccatgaacgcctataaagcagcggtagaagagaaatatcgcttttttagttacggtgatgcgatgtttatcacgtacaatccgcaggcaattaatgagcgcgtcggggagtaattccgcggcgctggtttaaaacgttggactgtttttctgacgtagtggagaaaaaatgaaatttgaactggacaccaccgacggtcgcgcacgccgtggccgcctggtctttgatcgtggcgtagtggaaacgccttgttttatgcctgttggcacctacggcaccgtaaaagggatgacgccggaagaagttgaagccactggcgcgcaaattatcctcggcaacaccttccacctgtggctgcgcccgggccaggaaatcatgaaactgcacggcgatctgcacgattttatgcagtggaaggggccgatcctcaccgactccggcggcttccaggtcttcagccttggcgatattcgtaaaatcaccgaacagggcgtgcacttccgtaacccgatcaacggcgatccgattttcctcgatcctgaaaaatcaatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcatccagggcagcgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgaaggcgtacgtcgtggtatcgatatgtttgactgcgtaatgccaacccgcaacgcccgaaatggtcatttgttcgtgaccgatggcgtggtgaaaatccgcaatgcgaagtataagagcgatactggcccactcgatcctgagtgtgattgctacacctgtcgcaattattcacgcgcttacttgcatcatcttgaccgttgcaacgaaatattaggcgcgcgactcaacaccattcataaccttcgttactaccagcgtttgatggcgggtttacgcaaggctattgaagagggtaaattagagagcttcgtaactgatttttaccagcgtcaggggcgagaagtaccacctttgaacgttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccattgccaaaggtgatgaagttctgacgaacggtggcctggttggtcgcgtaaccaaagtagcggaaaacggctacattgctatcgcgctgaatgacaccactgaagtagttattaaacgtgacttcgtagctgccgtcctgccgaaaggcaccatgaaggcgctgtaattaaaatttttccctaagggaattgccgtgttaaaccgttatcctttgtggaagtacgtcatgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccagttgcgcgctcgtgaagcattaatgggcgttatgggtgacaaatacgtcgtggcgcttaaccttgccccggcaacgccgcgctggctggcagctattcacgctgagccgatgaagctcggccttgacctgcgtggcggcgttcacttcctgatggaagtggatatggacaccgcgcttggcaaactccaggaacaaaatatcgatagcctacgcagtgacctgcgcgaaaagggcatcccgtataccactgttcgtaaagaaaacaactacggcctgagcatcactttccgcgatgctaaagctcgtgatgaagccattgcgtatctgagcaagcgccatccggacctggtgattagcagccagggcagcaaccagctgcgtgcggtaatgagcgatgctcgtctgagtgaagcgcgtgaatatgcggtgcagcagaacattaatatcctgcgtaaccgtgtaaaccaacttggcgtggcggagccggtggttcagcgtcagggtgctgaccgtatcgttgttgaactgccaggtattcaggacactgcgcgtgcgaaagagattctgggtgcgacggcaacgctggaattccgtctggtaaacaccaacgttgaccaggccgctgcggcatccggtcgcgtaccgggcgactctgaagtgaaacagacccgcgaaggtcagccagttgtgctgtacaaacgcgtaattctgaccggtgaccatatcaccgactccacttccagccaggacgaatacaaccaaccgcaggttaacatctcgctcgatagcgctggtggtaacatcatgtctaacttcactaaggacaacatcggcaaaccgatggcaaccctgtttgtggagtacaaagacagcggtaagaaagatgcaaatggtcgtgcggttctggtgaaacaggaagaggtgattaacatcgccaacatccagtctcgtctgggtaacagcttccgtatcaccggcatcaacaacccgaacgaagcccgtcagctgtcactgctgctgcgtgccggtgcgttgatcgcgccgattcagattgttgaagaacgtaccattggcccaaccctgggtatgcagaacattgaacaggggctggaggcttgccttgccggtctgctggtttctattctgttcatgatcatcttctataagaagtttggtctgattgcgaccagtgctctgattgccaacttgatcttaatcgtcggcattatgtcgctgttgccaggcgcaacgctgagtatgccaggtatcgcgggtatcgtcttaacccttgcggtggcggtcgatgcgaacgtactgatcaacgaacgtattaaagaagagttgagcaacggacgtactgttcaacaggcaattgatgaaggttatcgtggcgcattcagttctatcttcgatgcgaacatcaccacgctgattaaagtcatcatcctgtacgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctgaggagtgcgatgtggcacaggaatatactgttgaacaactaaaccacggccgtaaagtctatgactttatgcgctgggactactgggctttcggcatctctggtctgctgttaatcgctgctatcgttattatgggcgtgcgcggctttaactgggggctggatttcaccggtggtacggttattgaaattacgctcgaaaaaccggctgaaattgacgtaatgcgtgatgcattgcaaaaagccggttttgaagagccgatgctgcaaaactttggtagcagccatgacatcatggtccgtatgccgcctgctgaaggcgaaaccggcggtcaggtgttgggcagccaggttctgaaggtgattaacgaatccaccaatcagaatgcagcagtgaagcgtattgagttcgtcggtccgagcgtgggggcagaccttgcgcaaaccggtgcgatggcgttgatggcagcgctgctgtctatcctcgtgtacgtaggtttccgctttgagtggcgactggcggcaggggtggttattgcgctggcgcacgacgttatcattacgctgggtattttgtcgttattccatatcgagattgacctgaccattgtggcatcgttgatgtcggttatcggttactcgcttaacgacagtatcgtggtatcggaccgtattcgtgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctatgtggcatctgcgttggctctgaaactgggtatgaagcgcgaacacatgttgcagcagaaagtggaaaaagaaggggcggatcagccgtcaattctgccgtaatcaagttcccgttgatgttgaaaatcccggtcagaagatcgggattttttttgatgtatggagattgcgaaaatccccgcatcttgggaaactgcgcgtaaccctacatttcatccaggtaacttttcatggctatcatcccaaaaaactatgcgcggttagaaagcggctatcgcgaaaaagcattaaaaatctatccgtgggtctgcggtcgctgttcccgcgagtttgtttattccaacctgcgtgaacttaccgttcaccacattgatcacgaccataccaataacccggaagatggcagtaactgggaattgttgtgtctctattgccacgatcatgagcattcgaaatataccgaagcggatcagtatggtacgaccgttatcgcaggggaagatgcgcagaaagatgtcggtgaagcgaagtacaacccattcgctgacctgaaagcgatgatgaacaagaagaagtgattaaaacgtaaaattgcctgatgcgctacgcttatcaggcctacgttatttcagcaatatattgaatttacgtgcttttgttggccggacaaagcgtttacgccgcatccggcatgaacaaagcacacgttgttaacaatcagaaatgccgggaataaatcccggcattttcataatcagaagttgtaacctactaccaggtaaccaccccagccggtagagcgaacgttgaagttgccgttgccgaagttcagttctgcatcgtcgttccactgaccaccgtcgtgccagtaacgagctacgacagagtagtgccagtgatcgtagttcagagccagaatatggctggaagcgatagagttattagtacgggtcttaataccgttgattgcgttaccgctgtcatcccctaaatcggaaccccagtcgaagttggtgaagccgatgtagctcagctgaccgccccacagatcggtaatcggcacaaagtatttaattttgaaacggtaaccgtcccactcgttttcgttcgctgcgccatagttctgccactggtatttcgcatagacgttcatggacaggctcatcggcaggccagtgtcgatatcggtacccagacccatgtaccaggtgctctggcgaccatctttattacgacccatgtcgtaaatgtagttgttcgcgaagtaccactctttgaacggaccgaagctaaggtcagtattggtcagcttgtcgatggagaaacgtggttcgatttccataaacagcggagaaccgtggttccagatacctttagcatcggagttaccgccgaagaataccggcgcatccgcataaccatagaagtcgaaccagtcttttttagcgaatgcttcgtactcaaggtaggtatcgttgcggatctgcggtccgaaacgggtgtgatagcttccgacaacgttaacgctctggtgccaccagtcggaaagatactgcggtttgtcgttttcagctgcgttgacagtaaaagacgaagagagcgccagtaccgcaccggctgccagtaatgtttttttcatatgtatgccactgtttgaaaatcccttgcgggagtgaaaaaggcgcaaattgcgtttctaaatatttcgtatacagaggagcctattataaaaatcattgctcacaaaaatatgtttcgtttcacagttctatcatttacgtaatcgattgcgttcacgtttacacacattcgggcggggattgtactgactttcgcccttgttgcaaacttttactatcaatccaggtgatgtaagcagagtaacaaaatgacggggaaagatgttgcgggacgcacaaaatcgtcccgaaatacgtttactgcataacaggttgaatgtcgtggatacgtacaaagcctaactgatccacagaaatcccctttaactgtaacggaatatcaacatcgctgggggcgaggacgctggcaggggcattaatcaattgattctgcacattgatttcctgaaagttgtctattgttccctgaatttgcccatattcaacagttccgctgaatgcgggcaagggatcattcgactcaccctgaatacgtagtgtaagggtggtgccatctgcatcaggcgtaatattcaccagcgacatacgtaaagtaccgatctggctttccagtcttgccggtgttttcgctccaggcagaaggtaaaccccactgctggattttgcattcagcctgttttgctgagtgattttgactgtttcttgattgagttgcgtcatctcctggttcagcgtgctgacgctgtgtttcatctgtcgcacttcactttgctgcacacaggcgctaaggctgaacaggcttcccagcaggagcagtcgaaaaacgttagtattcataggtcgtccctttctcgtcgcaattagcctaatggtagagggtaaaagcagcgaaagcatcgatcctttatctcaaaagcgttgcgcctttgttgtatcgtcagttcagggtaaaatagatttccgttaaccacctggtcaggacgccgtatgcattgcccattctgtttcgccgtggacactaaggtaattgactctcgtctcgtgggcgagggttcatccgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattgcgtagcggaatgctgcgggcgctggaaaaacgtccggtgagttccgatgacgtcgaaatggcaatcaatcatattaaatcgcagctgcgcgccaccggtgagcgcgaagtgccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaagccgtgcaggacgagtattacatggcgcgggcgctaaagctggcgcaacgaggacgttttaccacgcatcccaacccgaatgtcgggtgcgtcattgtcaaagatggcgaaattgtcggtgaaggttaccaccaacgtgcgggtgaaccacatgccgaagtacacgcgttgcgtatggcgggtgaaaaagccaaaggtgcgaccgcctatgtcacactcgaaccctgtagccatcatggtcgtacgccaccgtgctgtgacgcactcatcgccgctggcgtagcgcgcgtggttgcctcgatgcaagatcctaacccgcaggtcgctgggcgtggactttaccgtctgcaacaggctggcattgacgtcagccacggcctgatgatgagtgaagccgagcaattgaataaaggctttctcaagcggatgcgcaccggctttccttatattcagttaaaacttggcgcatcgcttgatggtcgcacggcgatggcgagcggcgaaagccagtggatcacttcgccccaggcgcggcgtgatgtacaactactgcgcgcgcaaagtcatgccattttaaccagcagcgccacggtgctggcggatgatcctgccttaacggtgcgttggtctgaactggatgaacaaactcaggcgctctatccgcaacaaaatctccgtcagccgatacgtattgtgattgatagccaaaatcgcgtgacgccggtacatcgcattgtgcagcagcccggcgaaacctggttcgcgcgtacgcaggaagattctcgtgagtggccggaaacggtgcgtaccttgctgattccagagcataaaggtcatctggatctggttgtactgatgatgcaactgggtaaacagcaaattaacagcatctgggtggaagcggggccaacgctcgctggcgcattgctgcaggcgggtttagtcgatgagctgattgtctatatcgcacctaaactattaggcagcgacgcccgcggattatgcacgctgccagggcttgagaaattagccgacgccccccaatttaaattcaaagagatacgtcatgtaggcccggatgtttgcctgcatttagtgggtgcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccgttgtttgggtgcctggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggggttctgaccactgaaagcattgaacaagcgatcgaacgtgctggcaccaaagctggcaacaaaggtgcagaagctgcactgaccgcgcttgaaatgattaatgtattgaaagccatcaaggcctgaaattagtaaggggaaatccgtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaataccgcatacctcgacggactgatgaagccatacctgtcccgcctgctggaagaactgggacaggtagaaaaagcagtactgcgcattgcgctgtacgaactgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtgatatccaggccggtagattcacggaagaccgttccatgatcgccggccttttcttttttacctgctgaggcataacgtatggcatgtggcgagttctccctgattgcccgttattttgaccgtgtaagaagttctcgtcttgatgtcgaactgggcatcggcgacgattgcgcacttctcaatatccccgagaaacagaccctggcgatcagcactgatacgctggtggcgggtaaccatttcctccctgatatcgatcctgctgatctggcttataaagcactggcggtgaacctaagcgatctggcagcgatgggggccgatccggcctggctgacgctggcattaaccttaccggacgtagacgaagcgtggcttgagtccttcagcgacagtttgtttgatcttctcaattattacgatatgcaactcattggcggcgataccacgcgtgggccattatcaatgacgttgggtatccacggctttgttccgatgggacgagccttaacgcgctctggggcgaaaccgggtgactggatctatgtgaccggtacaccgggcgatagcgccgccgggctggcgattttgcaaaaccgtttgcaggttgccgatgctaaagatgcggactacttgatcaaacgtcatctccgtccatcgccgcgtattttacaggggcaggcactgcgcgatctggcaaattcagccatcgatctctctgacggtttgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcactgtgccggaactgaaccgtggcgcgctggatgtggctctcggacacctgggcgtaccgtttacctgtatcgggcaaatgaccgccgatatcgaagggctttgttttattcgtgacggcgaacctgttacattagactggaaaggatatgaccattttgccacgccataaagatgtcgcgaaaagtcgcctgaagatgagtaatccgtggcatctacttgctgtcggattcggaagtggattaagcccgatcgttcctgggacgatgggctcgctggcagcgattccgttctggtatctgatgacctttttgccctggcagctctactcgctggtggtgatgctggggatctgtatcggcgtctatctttgtcatcaaacggcgaaagacatgggtgtgcacgatcatggcagcattgtctgggacgaatttattggtatgtggatcacgctcatggcgctgccgaccaatgactggcagtgggttgccgccgggtttgtgattttccgtattctggatatgtggaagccgtggccgatccgctggtttgatcgcaatgtgcatggcggcatggggatcatgatcgacgatattgtcgccggggtgatttccgcaggcatcctgtattttatcggtcatcactggccgctgggtattctgtcgtagttgtgcaccgatgcctgatgtgacgcttgtcacgtctcatcaggcctggactcttatttaaatcctacgacaggatgcggtttatacggcgtttccagttcggcaatctgttccggcttcaaagtgatatccaccgcgttcaatagctcatcaagctgttcttcgcgcgaagttccgataatcggtgcggcaatgcccggtttactcaacaaccaggccagcgcaacttgtgctcgtgtcgcccccagttcttcactgacgcctgttaaccgctctgcgatctgcgcgtcattttcatcgctttctttatagagatttttccccacctcatcagacaccagtcgtgcggtagtttctccccacggacgcgtcagacggccccttgccagcgggctccatggaattaccgccacgccctcctgataacacagtggtagcatctcgcgctcttcttcacgataaatcagattgtagtgatcctgcatactgacaaactgcgcccagccgtgctgtttttggagttccagtgcctgagcaaactgcgaagcgtgcattgatgacgcgccgatataacgcgctttcccggcttttaccacgtcgttgagggcttccagcgtctcttcgatcggcgtgttgtaatcccagcgatgaatttgcaggatatcgacataatccatgccgagacgtcgcaggctgtcgtcgatagagcgcaaaatttgcgcacgggataatccttccggtaaatcaccaacgcgatggaacactttggtcgcaacgaccacgtcttcacgacgggcgaaatcccgcagtgcgcgaccgacgatctcttcgctgctgccgtcagaataactgttggcggtatcaaagaaatttatgccgccttccagtgcacgtttaattatgggacggctgctttcttccggcagtgtccatgcgtgattaccgcgatctggctcgccaaaggtcatacagccgaggcaaagtcgggaaacgcgaaggtcggtttttcctaaggggttgtattgcatgctgccactcctgctatactcgtcatacttcaagttgcatgtgctgcggctgcattcgttcaccccagtcacttacttatgtaagctcctggggcttcactcgtttgccgccttcctgcaactcgaattatttagagtctatgaataatttcttaagcatagcaggagtggagtagggattatgccagccaggccttgattttggcttccataccagcggcatcgaggccgagttcggcgcgcatttcttcctgagttccttgcggaataaagaagtccggcaggccaatgttcagcacgggtactggtttacgatgggccatcagcacttcgttcacgccgctgcctgcgccgcccataatggcgttttcttctacggtgaccagcgcttcatggctggcggccatttccagaattaacgcttcatcaagcggtttcacaaaacgcatatcgaccagcgtggcgttcagcgattcggcgactttcgccgcttctggcatcagcgtaccaaagttaaggatcgccagtttctcgccacgacgcttcacaatgcctttgccaattggtagtttttccagcggcgtcagttccacgccgaccgcgttgccacgcgggtagcgcaccgctgacgggccatcgttatagtgatagccggtatagagcatctggcgacattcgttttcatcgctcggggtcataatgaccatttccggtatgcagcgcaggtaagagagatcaaaagcaccctgatgggtttgaccgtcagcaccaacaatgcccgcgcggtcgatggcgaacaggaccggaagcttttgaatcgccacgtcatgcagcacctgatcataggcgcgttgcaggaaagtggagtaaatcgcgacaatgggtttgtacccaccaatcgccagacccgcagcaaaggtcaccgcgtgttgctcggcaattgccacgtcgaagtagcgatccgggaatttacgtgaaaactcgaccatgccggaaccttcacgcatcgccggagtaatcgccatcagcttgttgtctttcgctgccgtttcgcacaaccagtcgccaaagatttttgaatagctcggcaaaccgccgctacttttcggcaaacaaccgctggagggatcaaatttaggcacggcgtggaaagtgatcgggtctttttctgccggttcataaccacgaccttttttggtcatgatatgcaggaactgcgggcctttcaggtcgcgcatgttctttagcgtggtgataagccccagcacatcgtgaccgtccaccgggccgatgtagttaaagcccagctcttcaaacaacgtgccaggcactaccatgcctttaatatgttcttcggtgcgtttgagcagctctttaattggcggcacgccagagaaaacttttttcccgccttcgcgcagtgaagagtaaagcttaccggaaagcagctgtgccagatggttgttgagcgcgccgacattttcggaaatcgacatttcattgtcgttgagaatcaccagcatatcaggacggatatcgcccgcgtgattcatcgcttcaaacgccatgcctgcggtaatcgcgccatcgccaatgacacagacggtgcggcgatttttgccttctttttcggcagcaaccgcaataccaattccggcactgatggaggttgatgaatgcccgacgcttaatacgtcatattcgctttcgccgcgccacgggaacgggtgcagaccgcctttctgacggatggtgccgattttgtcgcggcgtccggtcaaaattttatgcggataagcctgatgccccacatcccaaatcaattggtcaaacggggtgttgtagacatagtgcagcgccacggtcagttcgaccgtgcccagcccggaggcgaagtgcccgctggaacggctcacgctgtcgagtaaatagcggcgcagttcgtcgcagagtttcggtaaactctctttcggcaacagtcgtaactcctgggtggagtcgaccagtgccagggtcgggtatttggcaatatcaaaactcatcaggggcctattaatacttattgtttatttattacgctggatgatgtagtccgctagcgcttccagtgccgaggtatcgagtgactgttcagccagttgtttcagcgactgacgggcatcgtcgatcagatcccgggctttcttccgggcttgctcaagacccagaagtgcagggtaggtacttttaccaagttgctggtcggcaccctggcgttttcccaacgttgcagtatctcccaccacatccaggatgtcatcctgaacctggaaggcaaggccgatgctctctgcatacttgtcgagtaccggcagagcacgacgtcctttatctccggcgcttaatgcaccaaggcgaacggcggcgcgaatcaatgcgccggttttatgacgatgaatacgctcaagcgcgtccagaggtacgtgtttgccttccgcgtctaaatctaatgcctgaccaccgcacattccggcaataccactggcgctcgccagttcagaaatcatcgaaattctgtcgcggtccgacacttccggcatatcggcatcgcttaaaatcgagaacgccagcgtttgtaaagcgtcgccagcgagaatcgcgtttgcttcgccaaacttcacatggcaggttggcaaaccgcgacgcagatcgtcatcatccattgccggtaaatcatcatgaattaatgagtaagcgtggatacactcaacggcggcagcgggtgcgtccagcgtgtttgtgctaacgccgaacatatgaccggtggcataaaccaggaaaggtcgcaggcgcttaccacctaataatgcgccatactgcatggtttcgaccacgggagtgttctgaaagggcagtggggcgataaaacggctcagcgcctggttggcctgcttaacgcaggcttcgagttgctgcggaaagtccattactcattgtccggtgtaaaaggggttagagaggcgtcttcattgtcagacagcagaatttgtacgcgctgttcggcttgttgtaatttggcctgcccctgacgtgccagctgcacgccgcgttcgaactcgttcagcgcctcttccagcggcaggtcgccactttccagacgggttacaatctgttccagctcgctcagcgccttttcaaagctggcgggcgcctcatttttcttcggcataatgaatgtctgactctcaatatttttcgccccgtcatggtaacggactcagggcaaatagcaaataacgcgcaatggtaaggtgatgtgcacagcaaagcgatgttagtggtatacttccgcgcctggatgcagccgcaggtgtgggctgctgtatttttccctatacaagtcgcttaaggcttgccaacgaaccattgccgccatgaagtttatcattaaattgttcccggaaatcaccatcaaaagccaatctgtgcgcttgcgctttataaaaatccttaccgggaacattcgtaacgttttaaagcactatgatgagacgctcgctgtcgtccgccactgggataacatcgaagttcgcgcaaaagatgaaaaccagcgtctggctattcgcgacgctctgacccgtattccgggtatccaccatattctcgaagtcgaagacgtgccgtttaccgacatgcacgatattttcgagaaagcgttggttcagtatcgcgatcagctggaaggcaaaaccttctgcgtacgcgtgaagcgccgtggcaaacatgattttagctcgattgatgtggaacgttacgtcggcggcggtttaaatcagcatattgaatccgcgcgcgtgaagctgaccaatccggatgtgactgtccatctggaagtggaagacgatcgtctcctgctgattaaaggccgctacgaaggtattggcggtttcccgatcggcacccaggaagatgtgctgtcgctcatttccggtggtttcgactccggtgtttccagttatatgttgatgcgtcgcggctgccgcgtgcattactgcttctttaacctcggcggcgcggcgcatgaaattggcgtgcgtcaggtggcgcattatctgtggaaccgctttggcagctcccaccgcgtgcgttttgtcgctattaatttcgaaccggtcgtcggggaaattctcgagaaaatcgacgacggtcagatgggcgttatcctcaaacgtatgatggtgcgtgccgcatctaaagtggctgaacgttacggcgtacaggcgctggtcaccggcgaagcgctcggccaggtgtccagccagacgctgaccaacctgcgcctgattgataacgtctccgacacgctgatcctgcgtccgctgatctcttacgacaaagagcacatcatcaacctggcccgccagattggcaccgaagactttgctcgcacgatgccggaatattgtggtgtgatctccaaaagcccgacggtgaaagcagttaaatcgaagattgaagcggaagaagagaagttcgacttcagcattctcgataaagtggttgaggaagcgaataacgttgatatccgcgaaatcgcccagcagaccgagcaggaagtggtggaagtggaaaccgtcaatggcttcggcccgaacgacgtgatcctcgatatccgttctatcgatgaacaggaagataagccactgaaagtcgaagggattgatgtggtttctctgccgttctataaactgagcaccaaatttggcgatctcgaccagaacaaaacctggctgctgtggtgtgagcgcggggtgatgagccgtctgcaggcgctctatctgcgcgagcagggctttaacaatgtgaaggtatatcgcccgtaatttgtggtttttacgtcgcatctggtcagatgcgacgtttgccgcatccgacactactcgtaataattataaatccctgccgccatcaccagttgtgatgccacttcatgggctttttcacgcccaaccaacaggtcgataattttcagaccaaagtcgatagctgtacccggcccctggctggtcagcaattttacccgtgcatcccagacgacgcgcttgtccagccattgttcggcgggaattttgtctttcagcgtcgggaagccggtcatattaccaatcgggaagatatcgtgcggcaccagcacggtggctggcgcggcgcaaatagccgcgacgatacgcccggaacggtggaactgtttaacggtttcaaccagcagagtgctatcgcgaaaacactccgcgcctttaatgccaccaggcagcacgatcacgtcatattcgccatcagccacttcgaccagcggcgcatccgccagcagcttcacgccgcgcgagcaggtaatcgccaggttaccatcgctggcgacgctggcagtggtgactttgataccgccgcgaaccagcagatcgatagtggtgacggcttcagtctcttcactaccaggggcgaggcaaaccagtgccgatgcgctcatattcactctcctttctttttaccatttcaaacaggcgggtgttttccggtacggcaatcccatgcgcgcgggcgcggcgtaagagaaaaccattgatatagtcgatttcagtgtggcgcagcgcgcggatatcctgcaacatcgacgagatattttccgctgtggcatcaatcacctgcatcacgtaatcacgcaaatcttctgctgaagtatgatgcccttcgcgttcgatcaccgccgcgacttcttcgcatatctgcataatttcttgcggatgatgacgtaattcaccgttcgggcaattccagatggcagtcagtggattaatcacgcagttgactgccagcttgcgccacagctcggcgcgaatattgttatgccaggcaacgtcaggcaacacggtttgcaaaatatccgccagataactgtaatccccgtcctgttgccgtgccgggccaatatgcgtgataccgtttgccacatgaataatgacattgccgtcgcggcgggctgcatgggtggtggtgcccatcagtaatggctgctgaatgttttgcaactcttcgatggtgcccatgccgttgtgaattaacagtattggcgtagttacaggcagtgtggacgcgaggcttttgacggcatcggaaacctgccatgctttcagcgtcaccaggagcagatcgctggtggcgagaaaatcgggatcgttggcggtcagcgattcgttaaatatcgaaccatctgtctcaaccagattcacgctacaataaggttgcggtacgcgcagccagccctgaacttcatgaccctgtttgcaaagtgctgtaagccataattgccctaaggcaccgcatcccaatacggtaattttcattgttcctcctcacccgcaaccactccgggtgttcaataaggctatcccttaattgtgcatgctgttgcgactatgcacaattaagggatacgtcctggtgcaggactgtcggttatttaactttgcgggtattatgcttcgcatcaaaaatgaagggagaggaaaagatgccatctttcgatattgtctctgaagttgatcttcaggaagcacgtaacgcggtcgataacgcgagccgcgaagtggagtcccgttttgacttccgtaacgttgaagcctcatttgagctgaacgacgccagcaaaaccatcaaagtgttgagcgagtccgatttccaggtcaatcagttgctggatattctgcgtgccaagctgctgaagcgcggcattgaaggcagttcgctggatgtaccggagaatatcgttcatagcggtaaaacctggtttgtggaagcgaaactgaaacagggcattgagagcgcgacccagaagaaaatcgtcaagatgatcaaagacagcaaactgaaagtgcaggcgcaaattcagggcgatgaaatccgcgtaacgggcaaatctcgtgatgatttgcaggctgtcatggcgatggtacgtggtggcgatctcggtcagccgttccagttcaaaaacttccgcgattaatcgcgactatgtgcgttttgttcatgtcagatgcggcatgaacgcctgattcggcctacaaaggtttgtaattcagaaactttgtaggcctgataagcgtagcgcagcaggcaattcgccgcgttttttatgcctgacgaattgcctgttctatctcaaagcgattcgtcactttgctgtcgattttcacataagctgaatgttcttcttctgcaatcaacacttctttgatgccttcagtttctagcaaacgcacttttaacgcctcgtttgcggcaatgttcgccgggatttcaatgcgcaaactgctgacatacggcggttctttcatggtactggcgactgtcagccacactgcggccagcattgcgccagcgagaaataccccctgaccgtcaaacatgccgttaatccagccgcccagcgaaccgccaatcgccacgccaagaaactggctggtggagtaaacacccatcgccgtacctttgtaacctgctggcgactctttactgataagtgagggcaggagggcttccatcaaattaaacgccacaaagaaaagctgcacgccgaccaccagttgccagaactgcgtttgcgcgttccacaacacaatttccgcaaccacgatcaacccgacgcagaagacaaagacttgcttcattttgcgcttaacttcagcgtagataatgaaaggcacgaccgagccaaaggcgattagcattgtcgccagatagaccttccagtgttcagccgccgggaaccctgcatcagccagttgtccgggcagggcaacaaacgtcgacatcagcaaaatatgcagacacataatgccaaagttgagtttcagcagccgcggttccgccagcactttactgaaactgcctttcaccattccggactcacgattaagtacgtgagtgctactgttgggcacaacccaaatggtcaacgcaatgccggtcgttgccagaatagcgatcatccagaacagcgcgtgcagcccaagtttgtgagtgatgatcgggccaagcaccatcgcaatggcaaaggtaatgccaaagctcacgccgataaacgccatcgctttggtgcggttttgttcgcgcgtgagatcggaaagcagcgccataacggcggcggcaattgctccagagccttgtagcgcccggcccagaataattccccagatggagtcggaaagcgcagcgataacgctaccggcggcaaacaccgccagcccaccgacaattaatggtttgcgaccaatgcggtcggaaagcaggccaaacggaatctgaaaaacggcctgagtcagaccataaataccaatggcaataccgattaatgcttcgctggcaccttgcagagccatgccgtacgtggtcagaaccggcagaaccataaacatgcccagcatgcgcaacgagaatacggtccctaaaccccaggtcgcgcgcctctcacctggcgtcattttataatcgttcattaccacctctgttttaaattcgcgactagtgtaaagcggcaaacgaatggggtaaacatgcggattttttagtaaatatttcgagagggatatgtttctaatgctaagaaaaaaggtgccgtagcacctttttaatagagaggttttgttaccacacagcagccagcagcgtatgcgagtccggtaccataaaatcaacggacatcatcaccgagagggcagtgatggcgatgatagagaagccgaacagcttgcgcgcccagattctgtcatcagcaactttataaccgcgcagagccatacctaaccaccagacgctaaccgccgcggcgaccaccagatatttatacccagcgtaaccgccaagagagagcatcagcgtggcaacggcaaaggcgatgatatacagcgtgatgtgattcttcgccaccgaaatgccttttaccactggcaataccggaatgtttgccgcctggtaatccttaaagcggaaaatggcgatggcataggagtgaggcatctgccacaggctgaagatagccagcaggatcgctgcgccgctatcgaactcaccggttaccgcacagtagccgatcaccggcggcgcagcgccggagagcgaaccaatcaacgtgccgtagacagagtggcgtttcatgtacaggctataaacgccgacataaaccacaaagcccatcacccccagccagcaggccagcggattcgcgccaaaccacagcagcataaagccagcaatacccagcaacgtggcgtacaccagcgagacagcaggagagatcaggcctttcaccagcacccgattcttcgtcctttccatctttctgtcgatatccctgtcgatgtagttgttaaacacacaacccgacgccacaaccagtgacaccccaaccagcgtgtagataaacaggggataatcaatgctgccctttgaggccagcaggaatcccccaatcaccgagatcaggttgccaaagatgatgcctggtttcgttacttgcaggtattgcttaaacatcataaccgccgctcttagtgcatcatcatgttgtagttgaggttccacataatccagatggagcctacaaccaggatagcgatgattagcacggtgaagacaaacgccgtcatgttccagccttcatctgatttggtattcatgtgcaggaagcacaccagatgcaccagaacctgtaccactgccattgccaggattgttcccagaattacggccggagaggcagctcctgtcatcaccatccagaacggaatcaccgtcagaatgatcgacaggataaagcctgtcatgtaggtttttacgctgccatgggacgcgccgctgtgatcggtagaatgactcattacatcgcccccatcagataaacaacagtgaacacacagatccaaaccacatccaggaagtgccagaacaggctcaggcacatgatgcgggtacggttagtgctggtcaggccgcgacgggcgatttgcaccatcagcaccgccatccagataagaccagaagtgacgtgcagaccgtgcgtgccgaccagcgcaaagaacgctgacaggaagccgctgcgatccggacccatgccgttaacaatcaggtgatggaattcatagatttccatcccgataaatccggcaccaaacaaccaggtcaacgccagccaggagataacctggcttttgttgtttttgtacatggcgatagccgccatgccgtaggtgatggagctgaacaacagcaagaaagtttcaaccagaacgaacggcagttcgaaaatgtccttacctgtcgggccgcctgcggtgccgttcaccagaacggcataggtagcaaacaagatagagaacagaatgcagtcgctcatcaggtagatccaaaatccgaagattttggttccgcctgcatcgtggtgcccgtgttcgtgcgcgtgggcagtcgcgtgcgtcaaagtatcagttgccatttttcagccctgccttagtaatctcatcgaaatgctggttttccagtttttcgatttctgccaccggcacgtagtaatccacgtcctcgtcgaagcttttcacgatccaggtgatgatcatgcctgcgaagccaacaatcgccagccaccagatatgccagatcatggcgaaaccgaagatggtggagaaagctgcaatgacgatacctgcaccgctgtttttcggcatatgaatttcttcatagtggtcaggctttttatacgcttcgcctttctctttcatttcccagaatgcatcacgttcgtgaacgtgcggcactacggcaaagttatagaacggaggcggggaagaggttgcccactccagcgtacggccaccccacgggtcgccagtcaggtcacggttctggtcgcggtcgcgaatagaaacgtacatctgaataacgaggcagagaatacccagcgcaatcagtactgcaccgctggctgcaatcatcagcatggtgtggaactgcgggtcaatctgctggctcaaacgacgggtcatgcccatgaagcccagcgcatacagtggcataaaggcaacgaagaagccgatgatccagaaccagaacgcgcgtttaccccaggtttcgttcagtttgaaaccgaacgctttaggccaccagtaggtcatccctgcgaagcagccgaagaccacgccgccgatgatcacgttatggaagtgcgcaatcaggaacaggctgttatgcagaacgaagtccgcgcccggtacggccagcagcacgccagtcatcccgcccaccgagaaggtgacgataaaaccgatggtccacagcatcgcagaatggaacacgatgcggccctgatacatggtgaacagccagttgaagatcttcaccccggtcgggatggcgataatcattgtggtgataccaaagaaggcgtttacgttcgcgcccgcacccatcgtaaagaagtggtgcagccaaacgatgaacgacagcacggtgatacagacggttgcccataccagcgaggtataaccaaacagacgtttacgcgagaaggttgccgcaatttcggagaacacaccgaaaacaggcaggatcaggatgtaaacttccgggtggccccaggcccaaatcaggttgatgtacatcatcatgttgccacccatatcgttggtaaagaaatgggtgcccagatagcgatccagggtcaacaacgcgacggtaaccgtcagaattgggaaggaagcaataatcagtacgttcgcgcacagtgatgcccaggtaaatactggcatcttgaacatggtcatgcccggtgcgcgcatcttcagaatggtaacgaagaagttgataccggtaagcgtcgtacctataccggatagctggagactccatatccagtaatcgacaccgactcccggactgtactctattcccgatagcggtggataggccagccagccggtctgcgcaaattcgcccacgccgagagaaacgttaaccagaatcacaccaacaacggtaaaccagaagcttaagttgttgaggaacgggaacgcaacgtcacgcgcgccgatctgcagcggaaccaccaggttcatcagaccgataacgaaaggcatcgccacgaagaagatcataatcacgccgtgcgcggtaaagatctgatcgtagtggtgaggtggcaggaagcccgcttcgcccgccgaggcaagagcctgctggctacgcatcataatggcgtcagcaaaaccacgcagcaacatcacaatcgccacgatgatatacatgataccgaggcgtttatggtcgacggaggtcagccactctttccacaggtaggtccacttaccgaagtaagtgatcaggccaacgagcgccagacctcccaaaataatgccagcgatcgtaaccatgacgataggttcatggaacgggactgcatcaagtgataattttccgaacatctttattcttcctcaacccctttaatgggcggattccgcgtggctcatgtccatgccttccataccttcgtgtgcgctgtgctcaccttctggctgggtcatgtccatgctcttaccgtgagccataaacttgttaattacatcggcaaacaagtctggtttcacgttggagaaatattccacctggttgtattcgctaggcgcggccagtttttcgaacgcagccatgtcagacatggtgttcggcgactgcttcgcttttgcgacccactggtcgaatgcggcgcgatccggtgttgcaatagctttgaacttcatgcctgagaagcccgggccgctgtagctggcggagataccgtcataagtgccgggttcgttggcgatcagatgcaggcgagtctgcataccggccatggcataaatctggctacccagacgcggaatgaagaaggagttcatcacggagttggaggtcactttgaagtacaccggagtgttcgccgggaaagcgatttcattcacggtagcaatgccctgttccgggtagatgaagaaccatttccagtccatggaaaccacttcgatggtaatgggcttctcgtcgtgtgccagcggcttgctaggctcaagagcgtgagtggttttccaggtcagtactgcaaggaagatgatgattaagataggtaccgtccagaccacagcttccactttattggagtgtgaccagttcgggctgtacttagcatctttattgctcgcacggtacttccaggcgaaaccaacagccatcaagattgcgggaataacgacaatcaacatcaggccaaatgccgtcagtatcagtgaacgttgctccagaccaatctgtcctttgggatctaacagcgcagaattacagccactgagcaatacagtgcctgcaaataatgacaaccatcccaaacttttattgtatttcctgagtctcatttaacgacctcaattccacgggatctggtggcgtttaaagtgtgtgggcattttacgggaaggttacattactgtaaacatgattaaattcctgttacttggatttggctgccaggtcacatatgttgcaaaacatatcaggttgattttaagaagctgttgcaaaagggcgttataacaaaaggggagtgctgaaggagtctgggcgggcaattggtataaccaatgtgaaataaaacaattatttaacaaataattatcattagagtgacaactgggtgatgagaaaataaagactcattagctgaatcgtgtaagaaaaatagaatttataaatggcgccaataatttccaaacgctaagccgcacaaaagaacaaatattaataagcgatactgatgtttatttagccgtaataattacggcgagtgattactacagctaaataatatttacagattacgtcagatgcgtttttcgtagcgccagataatccagcaaaccaccaagcacgacgccagaaagggcgactaaaaccccgacttccagcagagcaggcaggaaagagaagtgcgtcaaatccagcgcgtccatcgtcaatagcagtaaccacacggccaacaggctgacgcccgccgccagtgtccacatggcaaaggcataacctgccggatatgcggtacgggagataaagttgtcatttactcgtgtatattcaagcgtctggcggcaaaccagcagcaaaataagccctggtacggcagcggcgacggagaatagatagaatgtcgaccagccgtgtgcttcaacaaaccaacccgccacggggccgacataaactcgccctacagcagaaagcgctgagagcagggcaaattgagtagcggaaaatgacttattacatagcgtcattaacagcgcgacaaaggctgatgtgcccatcccgccacagaggttttcgaaaaagacggctgcgcccatgctgtagagatgcttatcagtaatcgacagcagccagtaaccggcgttagacgcaccttgtaaaatgccgaaaatcagcagtgcccggaacagtgacaggcgctgcatcaaaatcccaccgtacaatgcgccaacaatggtcgctagtaagccaagcgttttgttaaccacgcctacttcacccgcatcaaacccgacgccgcgaatcaaaaacgtggttgtcaggctcatggcgaatgcgtcgcccagcttatacagcacgataagaagcaaaataagccaggcattattgcgaccaaagaaatctcgcagaggtgcaacaaccgcttgttccagcgttttgggcacaggaatggtgtcggttggttctggtgcaagcaacgtcgcgataatacaggggatcaacagtgccgccattaaccagtacatgccctgccagcccagccatttatctgccagccacagggctaggccgccggaaaccagcatccctaaacggtaacccagcacgctgattgccgcgcccgcaccacgttcttctgccggaagcacatcggttttccacgcatcgaagactatatcctgggaagcagagcaaaaagcgatcaccactgccagcgccgccatccagcggagttgggtgcctggttcgagaaaacccatcgccgcaatggcgactaataacaggatttgcgtggcgagcagccaaccgcgccgccgcccaaaaaatggaggcgtgtagcggtccatcagcggtgaccagaggaatttaaaaacgtaagcctggcctaccagagagaagaaaccaatggttttgagatcgatattctcgaccgtcatccaggcctgtaaggtaccggatgtcagggcgagcggtagcccggaagcaaaacccaggatcagcaatatggctgaacgcggctgttgaaaaatacgtaaatattgactggacatgggcgtctacaggcccggcttgcaccgggccagagggcagaaattaacgcgcgttctgcttgatgaattcgtggatgctggtgtcctgagacatatcagcgatggtatcggtcagcacactgttaaccgcatcggcgatatttttgttggaggcctggaacgcaccttcaacgttgtagctggcacgatagtttttggtcattttgttgccattctgcgcggtagcgatgatggcgatatccgctttggtcgcgatgttgtagcgcacgttgccctgggacacgtcagcatacagttggctaacgatgatttgcagattaaccgggccattcggaccaaccatgtaaccacgcgcggtcatctgtttttccagcacttcttgcagcaggaaacgcagatcgcgggaggcggtcagggtaacgatttgattatcgcgggtgacttttgccagcgcctgatcggtacgctgatcggcaccattaatgcttacggtgacgcccatcaggcttggatcctgctgtggcagtgtaatcgtcggggaaacttcaatagttgttggcggttttgcgcatcctgcaagcataaacagagcaactaacgggaagaggatttttttgaacatgttcgggctctcagagactcttaagcgtgtttggtaaaaattcccgccatcataacattgccaacggcgaggggaagtgggtaaggcatgtaaattcatcatgttgacgaaataatcgcccctggtaaaagaaacactgatgcgaggcctgtgtttcaatctttaaatcagtaaacttcatacgcttgacggaaaaaccaggacgaaacctaaatatttgttgttaagctgcaatggaaacggtaaaagcggctagtatttaaagggatggatgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaattgcccgggaattgtgaaaaaatacgcgacagcgcgcaataaccgttctcgactcataaaagtgatgccgctataatgccgcgtcctatttgaatgctttcgggatgattctggtaacagggaatgtgattgattataagaacatcccggttccgcgaagccaacaacctgtgcttgcggggtaagagttgaccgagcactgtgattttttgaggtaacaagatgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgttgctcagcgttatggcgcgtctgtacgccaggacgttctgggtgacctgatgagccgtaacttcattgacgccatcattaaagaaaaaatcaatccggctggcgcaccgacttatgttccgggcgaatacaagctgggtgaagacttcacttactctgtagagtttgaagtttatccggaagttgaactgcagggtctggaagcgatcgaagttgaaaaaccgatcgttgaagtgaccgacgctgacgttgacggcatgctggatactctgcgtaaacagcaggcgacctggaaagaaaaagacggcgctgttgaagcagaagaccgcgtaaccatcgacttcaccggttctgtagacggcgaagagttcgaaggcggtaaagcgtctgatttcgtactggcgatgggccagggtcgtatgatcccgggctttgaagacggtatcaaaggccacaaagctggcgaagagttcaccatcgacgtgaccttcccggaagaataccacgcagaaaacctgaaaggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgatcgaaggtctggtaaaagctaacgacatcgacgtaccggctgcgctgatcgacagcgaaatcgacgttctgcgtcgccaggctgcacagcgtttcggtggcaacgaaaaacaagctctggaactgccgcgcgaactgttcgaagaacaggctaaacgccgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaagctgtactggcgaaagcgaaagtgactgaaaaagaaaccactttcaacgagctgatgaaccagcaggcgtaatttacgcagcataacgcgctaaattcgcacaaaggcccgtcaccgccaggtggtgggcttttttttgtcatgaattttgcatggaaccgtgcgaaaagcctctttcggtgttagcgtaacaacaaaagattgttatgcttgaaatatggtgatgccgtacccataacacagggactagctgataatccgtccataaggttacaatcggtacagcaggttttttcaattttatccaggagacggaaatgtcatacagcggcgaacgagataactttgcaccccatatggcgctggtgccgatggtcattgaacagacctcacgcggtgagcgctcttttgatatctattctcgtctacttaaggaacgcgtcatttttctgactggccaggttgaagaccacatggctaacctgattgtggcgcagatgctgttcctggaagcggaaaacccagaaaaagatatctatctgtacattaactccccaggcggggtgatcactgccgggatgtctatctatgacaccatgcagtttatcaagcctgatgtcagcaccatctgtatgggccaggcggcctcgatgggcgctttcttgctgaccgcaggggcaaaaggtaaacgtttttgcctgccgaattcgcgcgtgatgattcaccaaccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttccgcccctgaagcggtggaatacggtctggtcgattcgattctgacccatcgtaattgatgccagaggcgcaactgtgccgctatacttatccagggcggcacaacgctgtaagcggcttgcgcctgagaatggcatttgcgtcgtcgtgtgcggcacaaagaacaaagaagaggttttgacccatgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggccaggaacaggcgaaaaaagtgctggcggtcgcggtatacaaccattacaaacgtctgcgcaacggcgataccagcaatggcgtcgagttgggcaaaagtaacattctgctgatcggtccgaccggttccggtaaaacgctgctggctgaaacgctggcgcgcctgctggatgttccgttcaccatggccgacgcgactacactgaccgaagccggttatgtgggtgaagacgttgaaaacatcattcagaagctgttgcagaaatgcgactacgatgtccagaaagcacagcgtggtattgtctacatcgatgaaatcgacaagatttctcgtaagtcagacaacccgtccattacccgagacgtttccggtgaaggcgtacagcaggcactgttgaaactgatcgaaggtacggtagctgctgttccaccgcaaggtgggcgtaaacatccgcagcaggaattcttgcaggttgatacctctaagatcctgtttatttgtggcggtgcgtttgccggtctggataaagtgatttcccaccgtgtagaaaccggctccggcattggttttggcgcgacggtaaaagcgaagtccgacaaagcaagcgaaggcgagctgctggcgcaggttgaaccggaagatctgatcaagtttggtcttatccctgagtttattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggtgcccgtggcctgcgttccatcgtagaagccgcactgctcgataccatgtacgatctgccgtccatggaagacgtcgaaaaagtggttatcgacgagtcggtaattgatggtcaaagcaaaccgttgctgatttatggcaagccggaagcgcaacaggcatctggtgaataattaaccattcccatacaattagttaaccaaaaaggggggattttatctcccctttaatttttcctctattctcggcgttgaatgtgggggaaacatccccatatactgacgtacatgttaatagatggcgtgaagcacagtcgtgtcatctgattacctggcggaaattaaactaagagagagctctatgaatcctgagcgttctgaacgcattgaaatccccgtattgccgctgcgcgatgtggtggtttatccgcacatggtcatccccttatttgtcgggcgggaaaaatctatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaaactgcctgacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctgaacaaaaaaatcccaccagaagtgctgacgtcgctgaatagcatcgacgatccggcgcgtctggcggataccattgctgcacatatgccgctgaaactggctgacaaacagtctgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaggcaaaagagaaagcggaagcagagttgcagaagctgaaaatgatgtctccgatgtcggcagaagcgaccgtagtgcgtggttatatcgactggatggtacaggtgccgtggaatgcgcgtagcaaggtcaaaaaagacctgcgtcaggcgcaggaaatccttgataccgaccattatggtctggagcgcgtgaaagatcgaatccttgagtatcttgcggttcaaagccgtgtcaacaaaatcaagggaccgatcctctgcctggtagggccgccgggggtaggtaaaacctctcttggtcagtccattgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctctgcactgcttgaagtgctggatccagagcagaacgtagcgttcagcgaccactacctggaagtggattacgatctcagcgacgtgatgtttgtcgcgacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggcgataacctgcatgactatctcggtgttcagcgtttcgactatggtcgcgcggataacgaaaaccgtgtcggtcaggtaaccggtctggcgtggacggaagtgggcggtgacttgctgaccattgaaaccgcatgtgttccgggtaaaggcaaactgacctataccggttcgctcggcgaagtgatgcaggagtccattcaggcggcgttaacggtggttcgtgcgcgtgcggaaaaactggggatcaaccctgatttttacgaaaaacgtgacatccacgtccacgtaccggaaggtgcgacgccgaaagatggtccgagtgccggtattgctatgtgcaccgcgctggtttcttgcctgaccggtaacccggttcgtgccgatgtggcaatgaccggtgagatcactctgcgtggtcaggtactgccgatcggtggtttgaaagaaaaactcctggcagcgcatcgcggcgggattaaaacagtgctaattccgttcgaaaataaacgcgatctggaagagattcctgacaacgtaattgccgatctggacattcatcctgtgaagcgcattgaggaagttctgactctggcgctgcaaaatgaaccgtctggtatgcaggttgtgactgcaaaatagtgacctcgcgcaaaatgcactaataaaaacagggctggcaggctaattcgggcttgccagcctttttttgtctcgctaagttagatggcggatcgggcttgcccttattaaggggtgttgtaaggggatggctggcctgatataactgctgcgcgttcgtaccttgaaggattcaagtgcgatataaattataaagaggaagagaagagtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgttaaagagcgtgctgcccgtactggccgcaacccgcagaccggtaaagagatcaccatcgctgctgctaaagtaccgagcttccgtgcaggtaaagcactgaaagacgcggtaaactaagcgttgtccccagtggggatgtgacgaagttcaagggcgcatctactgatgtgccttttttatttgtattcggtgactttctgcgtcttgtgggctgacaattgcccccgtttcttgtcacaataggcctttgcgcgcatcgatacgttgcgtgaggtacacagtcatctacagcggagtgttgttacaccatgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccaggaaatcagccgtgggcaattcgagaacgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgctgctggatcagtacgcacgtgagctgaaactgggtatcagcgatgagcaggttaaacaggcgattttcgcgaccccagccttccaggttgacggcaaatttgataacagccgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtcgcgcaacaacgcgtggtgcgtgaggcgactatcgatgttaacgcgctggcggcgaagcagcctgtgaccgaacaggagattgccagctactacgaacaaaacaaaaacaatttcatgacgccggaacaattccgcgtgagttacatcaagctggatgccgcaacgatgcagcaaccggttagcgatgcggatatccagagctactacgaccagcatcaggatcaattcacccagccgcagcgtacccgctacagcatcatccagaccaaaactgaagatgaagcgaaagcggtacttgatgagctgaataaaggcggtgattttgctgcattagccaaagaaaaatctgccgatattatctctgctcgtaacggcggcgatatgggttggttagaagatgccactatcccggacgaactgaaaaatgctggtctgaaagaaaaaggccaactgtctggtgtcatcaaatcttcggtcggtttcctgattgtacgtctggacgacattcagccagcgaaagtgaaatcgttagacgaagtacgtgacgacattgcggcgaaagtgaaacacgaaaaagccctcgatgcgtactacgcgctgcagcagaaagtgagcgatgcggcaagcaacgacaccgagtctctggccggtgcagagcaagctgccggcgttaaagccactcagacgggttggttcagcaaagataacctgccggaagagttgaacttcaagccggttgccgacgctatctttaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcattggttcagcacaacaaagctgaacaacaggcgaaagtggatgctgagaaactgctggttgatttgaaagccggcaaaggtgcggaagctatgcaggctgccggtctgaaatttggcgagccgaaaaccttaagccgttccggtcgtgacccgattagccaggcggcgtttgcactgccactgccagcgaaagacaaaccgagctacggtatggcgaccgatatgcaaggtaatgtggttctgctggcgctggatgaagtgaaacaaggttcaatgccggaagatcagaaaaaagcgatggtgcagggtatcacccagaacaacgcacaaatcgtctttgaagctctgatgagtaacctgcgtaaagaggcgaaaatcaaaattggcgatgcgctggaacagcaataatcctgaagccgcctcgcaaaaaaatgcgttgcagctgtaacaagaaaaggtcgctttcgcggccttttccatttctgaacattgccatttgtttactgttttcactgccgttaaggtgattccactgttaacaaacaaggagaaaacagtatgaaacacggaattaaagcactgctcattaccctgtccctggcctgtgccggaatgtctcatagcgcgctggcggcagcttctgtggcgaaaccgacggcggtagaaaccaaagcggaagctcctgcagcacaaagtaaagcagcagtaccggcgaaagccagtgacgaagaaggcacccgggtcagcattaataatgccagcgcggaagagctagcccgcgcgatgaatggcgttggcctgaagaaagcgcaggcgattgtcagttatcgcgaagagtacggtccgtttaaaactgtggaggatctaaagcaggtgccggggatgggcaattcgctggtggaacgtaatctggcggtattaaccctgtaattaatttgcatagtggcaattttttgccagactgaagaggtcataccagttatgacctctgtacttataacaacaacgtaaggttattgcgctatgcaaacacaaatcaaagttcgtggatatcatctcgacgtttaccagcacgtcaacaacgcccgctaccttgaatttctcgaagaagcccgctgggatgggttggaaaatagcgacagttttcagtggatgacggcccataacatcgccttcgtcgtggtcaatatcaatattaactatcgtcgcccagcggtattaagtgacctgttaactattaccagtcagttgcagcaattaaacggtaaaagcggcatcttaagccaggtcattacactggagccggaagggcaggtggtagcggatgcgcttattacgtttgtttgtattgatcttaaaacgcagaaagcattagctctggaaggggaattgcgcgaaaagctggagcagatggttaagtaaacgttttgtggtgccggatgctcaagccgcatccggcgacacccggaataattacctcaacccggttttctgcttcatcgctgccatcaccgtcggtttatcggccagataatgattcaaaccgttggcgcgtaaattacatgccgcacaatgaccgcaaccgtcgcctttaaagccgttatagcaggtcaacgtttcgttacggactaaatccagtttgccgtaataatctgccagcgcccaggtttccgctttatcaatccacatcagcggcgtttcaaaacgaatatctttcgccatgcccaaactgacggcatggtttagtgctttcacaaactcatcgcggcaatccgggtagccggagaaatccgtttcgcagacgccagtaattacggcttctgcttttacctgatacgcatatattgccgccagcgtcaggaacaaaatattacgccctgggacaaacgtattcgggataccatcggcttcaggttcataatcaggcaccggaatgctgtcacgcgtcaggctactgaccgccagctcgttgagcagggtgacatccagcaccttatgcgcgcgtgcccccagtttcagcgccagttcgcgtgccacgtcgatttctgcgcgatgccgctgaccgtaatcgaacgtcacgcaatggacttcatcatattgttgtaatgcctgcaccagacaggtggtggaatcctgacctccactgaacacaacgacagcacgtttcatagataatcctgcttgaacaataaaagcgttatggtaacgcctgcgattaacccggaccagctattcattgcgatggcgcgggaagccaggcttcggtaaattcaaaccagccgcgcggtgtcagtcgcacaccgttcacgccgggaggggcactaatgcgatagtgatagttgaacagcggcgtcagcgtcgcatctgtcattaactggctaaaaaccgctttcagggcattaaatcggttttcttcatcaggcattatttgcacggcatccagtgtcgattgtagatgtgcgtatgctggagcgtcgaaaacatgtggccacagcggatcgcagcgcagccattgctccagagtatattccggtgcttcgccaattaatctgtcgcccatcatgaggtctgcgtgtgcctgtagggtcgtgtcgtcccagttttttgcgttatgaaaaataattgtgagttcacagccttccgctgccagtgtcgcctgtaggcgttctgccatggtatgaagttctatcggtaggtgataaaccagcgtcaaggttttcggtagtttgacttcatccggtacctgccaatgcggaatagtccagcctggcagtaatgcatgactggcggtgatcaggttttctccgacttctaacgtttgtaataaaccggattgatgaataatggagatcacttttcgcgcctgccagagggagagtcggggacttttgcgcaacgtcaaatagcaaaaacctaaactgatgccgctactgacctggctgacccgttgcagctcctccggtttgccgatggtgatttgcacgggatgccgacaactggttcccaaatctttttcgaaaagcggcggagttatccagtactcaaccgctttaagcagcggatgacgtaaatggtaataatcatggctttccaggcgcaccagctctgctgtgaattgtgttaagcgaaaaggacccgtgccgatcagtgggaattgcggatgcgccagatggctgcaatagctcgccagccggtgcgcaagccagtaatcagggcgatgtaaaaagaaggtcagacactgcggatgggtgacttcaatacgcttcacgctaataaataattgatccagtgctggcagttgtaacagcatcaataatcgctggtgtaagtgtgaggcttttactgcatcgccgttatgccagtgtagggttgaacgaagataaaagtcccagcgtaacccgtcagtagaggtttcccagtgatgcgctaaatcgccaatcgggcgctgagtattattatcgaagcgggtcaggccggaaaatatctgcccggcgagatgctgctcggcacggccgggcaaaaagcctggttgtagcggttcgagcgggcgatagtagggaatacgcaacgtgggtgtatcgttttgccattgtccgcccataaacggctgtaacagagtgcgcagctcacctggggccagttgcgccagctccagcacatcttgctgctttccggtttccagtgcctgttccatcatcgcattgcgtagcgattccggcgtgaccagaaagcgtaattgtccgcgctttccgcgtcctgactgcgcctgccactccagccatcccgcctcctgtgcctgacgcaacagcgtacgaacatggcgttcgctgcaaaaacagcgttcggccagttcgctgacggtgacggtttgcggctttccggcggaaggttgccacagacgttgatactggttaagacggttgagcaatcgcatataaacccggaacaatattatttaactattcactattacttccgtatatatcaggtgatactcaatcaccattaaccgtgtcacagagtggagaaagaaatggctcgtctggcagcatttgatatggatggcactttattgatgcccgaccatcatttaggtgagaaaaccctctctactttggcgcgactgcgtgaacgcgacattaccctcacttttgccacggggcgtcatgcgctggagatgcagcatattctcggggcgctatcgctggatgcgtatttgattaccggcaacggaacgcgcgtgcattctctggaaggtgaacttttacatcgtgatgatttacctgcggatgtcgcggagctggtgctgtatcagcaatgggatacccgagccagcatgcatatcttcaatgacgacggttggtttaccgggaaagagatccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttgtgtttttccgccacggattgcctcgaagtgctgccggtgggctgcaataaaggcgctgcattgacggtgctgacccaacatttaggtttatcgttgcgcgattgcatggcctttggtgatgcgatgaacgatcgcgaaatgttagtcagcgtcggtagcggatttattatgggcaatgcgatgccgcaactgcgcgcggagctcccgcatttaccggtgattggacattgccgaaatcaggctgtctctcactatttgacgcactggctggactatccacatctaccttattcccccgaataacgagatcccttccagcaccgggcaattgcccggttttttttgcgttgaatttgtcattttgtgccgtggtgtttaaaccgcacagaataaattgtcgtgatttcacctttaaaataaaattaaaagagaaaaaaattctctgtggaagggctatgttagataaaattgaccgtaagctgctggccttactgcagcaggattgcaccctctctttgcaggcactggctgaagccgttaatctgacaaccaccccttgctggaagcgcctgaaacggctggaggacgacggtatccttatcggcaaagtcgccctgctggatccggaaaaaataggcctcggcctgaccgcttttgtgctgataaaaacgcaacatcacagcagcgaatggtattgccgctttgtcacggtggttaccgaaatgccagaagtgctggggttctggcgcatggctggtgaatacgattatctgatgcgcgtccaggttgccgacatgaaacgctacgacgagttttataagcgtctggtaaacagcgtgccggggctgtcggacgtcacttccagcttcgcgatggaacagattaaatacaccacttctttacccatcgaataaatatccagaatcaggtcaggacacaacgcgtgcgattatttgctcaattaagctggtatttccgtcgggaatggcgtcgctatctcggggctgtcgccttgcttgtcattatcgcgatgctgcaactggttccgccaaaagtggttggtattgttgtcgatggcgtgacagaacaacactttactaccgggcagatcctgatgtggatcgccaccatggtgctgattgccgttgtggtttatctcctgcgttacgtctggcgggtattgctgtttggtgcgtcttatcaactggctgttgaactgcgtgaagattattaccgtcagctaagccggcagcatcctgagttttacctgcgtcatcgcaccggtgacctcatggctcgtgcgaccaatgacgtcgatcgcgtcgtgtttgccgccggagaaggggtgctgacgctggtggattcactggtgatgggctgcgctgtgttgattatgatgtctacgcaaattagctggcagttgaccttattttccctgttgccgatgccagtgatggcgatcatgattaagcgcaacggcgatgctttgcatgaacgctttaagctggcacaggcggcgttttccagtcttaatgaccgcacccaggaaagcctcaccagtatccgcatgatcaaagcctttggtctggaagatcgccagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtgcagggcagtttaacgctgggccagctcaccagttttatgatgtatttaggtctgatgatttggccaatgctggcgctggcatggatgtttaacattgtggaacgtggtagtgctgcgtacagccgtattcgcgcgatgctggcggaagcgccggtggtgaacgatggtagcgaacccgtgccggaagggcgtggcgaactggatgtaaatattcaccagttcacgtatccgcagactgaccatcctgcgctggaaaacgtcaatttcgccctgaaacccggtcagatgctgggtatctgcgggccgactggttccggcaaaagtaccctgttgtcgctcattcagcgtcatttcgacgtcagcgagggggatattcgctttcatgatattcctctgacgaagttacaactcgatagctggcgtagccgcctggcggtagttagccagacgccattccttttttctgacactgtggcgaataacatcgcgctgggttgcccgaatgccacccagcaagagattgagcatgtcgcgcggttagccagcgtacatgacgatattttgcgtctaccgcaaggttacgatacagaggtgggcgagcgcggtgtgatgctttccggcgggcaaaaacagcgtatctccattgctcgtgcgttattagtcaacgcggaaatcctcatccttgatgatgcgctttcggcggtggacggacgcactgagcaccagatcctgcataacctgcgtcagtgggggcagggaagaacggtaatcatcagtgcccatcgcctttctgcactgacggaagccagtgaaattattgtgatgcagcacggacatatcgcccagcgtggcaatcatgatgtgctggcacaacaaagcggctggtatcgcgatatgtatcgctatcaacaactggaggcggcgctcgacgacgctccggaaaatcgcgaggaggccgtcgatgcgtagttttagccaactgtggccgactctcaagcgcctgttagcgtacggttcgccgtggcgtaaaccgctggggattgcggtcctgatgatgtgggttgcggcggcggcagaagtcagtgggccgctgcttatcagctattttatcgacaatatggtagcgaaaaataacctgccgttgaaagtggttgcagggctggctgcggcgtatgttgggctgcaactgtttgccgccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgcagtgccgcgctggtgggcgcgatgctggtggcgatgttcagcctcgactggcgaatggcactggtggcgataatgattttcccggtggtgctggtggtaatggtgatataccagcgttacagcacgccgattgtccgtcgtgtgcgcgcctatttggcggatatcaacgacggctttaacgaaatcatcaatggcatgagcgttatccagcagtttcgtcagcaggcgcgatttggcgaacgtatgggggaggccagtcgttcacactatatggcgaggatgcaaaccctgcgcctcgacggttttctgctgcgtccgctgctgagtctgttttcatcgctcattctttgtggcttgttgatgctgtttggcttctccgccagcggcaccattgaagtgggcgtgctgtatgcgtttatcagctatcttgggcgacttaacgaaccattaatcgaactgaccacgcaacaggcgatgctgcaacaggctgttgttgctggtgagcgcgtgtttgaactgatggacggaccgcgccagcaatatggcaatgatgatcgcccgttacagagtggcaccatcgaagtcgataacgtgtcatttgcttatcgcgatgacaatctggtgctaaagaacattaatctctctgtgccttcgcgcaattttgtggcgctggtcgggcataccggcagtggcaaaagcaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgggatatctccgaagaacgcgtctggcaggcgctggaaaccgtgcaactggcggagctggcgcgtagcatgagcgacggtatttacacgccgctgggcgagcaggggaataatctctcagttgggcaaaagcaactgctggcactggcgcgcgtgctggtcgagacgccgcaaatcctgatccttgatgaggcaaccgccagcattgactccggtactgaacaggcgattcaacatgctctggcggcggtgcgtgaacataccacgctggtagtgattgctcaccgcttatcgaccattgttgatgccgacaccattctggtgcttcatcgtgggcaagccgtggagcagggcactcaccagcaactgctggcggcccagggacgctactggcagatgtatcaactgcaacttgcgggcgaagagctggcagccagcgtgcgtgaagaggaatcattgagcgcctgaatagcgcaatatttcatcgttggtgcaaaaatgtaacgcactgtgcactgtcatagtgcgttttcattttcaaacttcttaacttcctgctctctttctcgtttttcatttctggcacaccgcttgcaataccttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaagggcatgccgagctgtaccggggggcggaatacagcgtcaatttcctgccaaaagtaaaaattgatgtggcgattgctgatgaccaactcgatgaagtgatcgatatcgtcagtaaggcggcttacaccggaaaaattggcgacggcaaaatcttcgtcgctgaattgcaacgcgtcattcgtattcgtaccggcgaagccgacgaagcggcgctgtaatctctggcacacagcaacaggaacgaaaaatgaagatagcgacgataaaaactgggcttgcttcactggcgatgcttccgggactggtaatggctgcacctgcggtggccgataaagccgacaatgcgtttatgatgatttgtactgcgctggtgctgtttatgactattccggggattgccctgttttacggtgggttgattcgcggcaaaaacgtgctgtcgatgctgacgcaggtgacggtgacatttgcactggtctgtattctctgggtggtttacggttactcgctggcgtttggtgagggcaacaacttcttcggcaacattaactggttgatgctgaaaaacatcgaactgacggcggtgatgggcagcatttatcagtatatccacgtggcgtttcagggatcgtttgcctgcattaccgtcggcttgatagttggggcgctggcggaacgaatccgcttctcagctgtgttgattttcgtggtggtatggctgacgctctcttacattccgattgcgcatatggtgtggggcggtggtttgctggcttctcacggtgcgctggatttcgcgggtggcaccgtggtgcacattaacgccgcaatcgccggtctggtgggcgcgtatctgataggaaaacgcgtgggcttcggtaaagaggcgtttaaaccgcacaacctgccgatggtcttcaccgggactgccattctctatatcggttggtttggctttaacgccgggtcagcgggcacggcgaatgaaatcgcggcactggcatttgtgaatactgtggtcgcaacggcggcggcaattcttggctggatcttcggtgaatgggcgctgcgtggtaagccttcactgctgggggcgtgttctggcgcgattgccggtctggtcggcgtgacgccagcctgcggctacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggcattgtcggctgtatcatgaccgggatttttgccgccagctcgctgggcggcgtgggcttcgctgaaggtgtgacgatgggccatcagttgctggtacagctggaaagcatcgccattacgatcgtctggtccggtgttgtggcatttatcggctacaaattggcggatctgacggttggtctgcgtgtaccggaagagcaggagcgagaagggctggatgtcaacagccacggcgagaatgcctataacgcgtaacaagcactgcaaaaaacagccggacggttttcacctccggctatttttttaattgtgattacgcatcaccccttcctgaacggtcgaggcaaccagtacgccgtcttgggtataaaactcaccgcgcacaaagccacgtgcgctggacgccgaggtgctctccacgctatacagcagccattcattcaaattaaacgggcgatggaaccacatggaatggtcaatggtggcaatctgaatccccggttcgagaaaaccgatgccgtgcggctgtagagctaccggcaggaagttaagatcagaagcgtaaccgagcagatactgatgaacgcgcaggtcatccggcacgctaccatttgcgcggatccacacctgacgatgtggttctgcgacgtgacctttcagtgggttatgaaactccaccggacggacttccagcggacgatcgcagatgaatttatctttcagcactggcggcagcaggtgcgccagcgattgggcgatttgcgtttccgaagggaggccatcaggcgctggcgcggacggcattgttttttgatgttcgaaacccgcttctggtgcctggaaagaggcagtcatataaaaaatcggtttgccgttttgaatagcagcaacccggcgggcgctgaagctgttaccgtcacgcagcgtttcgacatcataaataatcggcttcttactatcgccagggcgaagaaagtagctgtgaaacgaatgtaccagccgctcttcagggacggtctcttttgcagcatacaaggcctgacccacgacctggccgccaaacacctggcgtaaacctaaatcttcactctggccgcgaaagagtccttcctcaattttttccagatttaacaatgtcagtaaattttttagcgcctgactcatataactctccagtaacaaagctgccgcagcaagccaaagtgagttgagtataacgcaaatttgctactggtccgatgggtgcaatggtctgaattacgggctaattacaggcagaaatgcgtgatgtgtgccacacttgttgacgttactattttgttaaccactcttccggcgaggaaagttagcccgctggtgcattgataataaggagaaatgaatgaaactcgtgcacatggccagtggtttagcggttgcgattgcgttggcggcttgcgcagataaaagcgcggatattcagacgccagcaccggctgcaaatacgtctatttcagcaacacaacaaccagctatccagcaaccgaatgtctccggtaccgtctggatccgtcagaaagtcgcactgccgcctgatgctgtgctgaccgtgacactttctgacgcgtcgttagccgatgcaccgtcaaaagtgctggcgcagaaagcggtgcgtactgaaggtaaacagtcaccattcagctttgttctgtcatttaacccggcagatgttcagccgaacgcgcgtattctgttgagtgcggcgattaccgtgaatgacaaactggtatttatcaccgataccgttcagccggtgatcaaccagggcggaactaaagccgacctgacattggtgccggtacagcaaaccgccgtgccggttcaggccagcggtggcgcaacgactaccgtaccttcgacttcaccaactcaggtgaatccgtcttcggcagttccagctcctacgcaatattaagcgacgttaaccctctccgcccggagagggttagtagttccagcgataacgctgcaagtcgatttgcccgcttcccgataccatcacaccttctgccagtaatgcctgtcgctgacgctgtaaatccggtccggttagcgaaattgtgccgtggcgattaaccacccggtgccagggtaaggtgctgccttcagggagacgctttaacacaccgcccacctggcgcgcggcgcggggcgatcccgccagtttcgccacatcaccgtaagtggtgacatagccttcgggaatagcggcgacgatttgccagacgcgttggggaaatgaatcttctttttccatcttttcttcctgaggtaatttttcagcataatctggaaaaacgcccgagtgaagtcgcattgcgcaagaaaccagcatctggcacgcgatgggttgcaattagccggggcagcagtgataatgcgcctgcgcgttggttctcaacgctctcaatgggggctctgttggttctcccgcaacgctactctgtttaccaggtcaggtccggaaggaagcagccaaggcagatgacgcgtgtgccgggatgtagctggcagggcccccacccatttctgcctcccaccgtttcgtcaaaaaatcccaacatggctaaactttaaccacaactgacgtcgcaagaattgtctggctgcgcagtacgcttcggaggtatgtctgatgaagtatgttgatggttttgtggttgccgttcctgccgataaaaaggatgcctatcgggaaatggccgctaaggctgcgccattgtttaaagagtttggcgcgcttcgtattgtcgaatgctgggccagcgatgtaccggatggcaaagtgaccgattttcgtatggcggtgaaagcggaagagaatgaagaggttgtctttagctggattgaatacccttcaaaagaggtccgcgacgctgctaatcaaaagatgatgtcggacccacggatgaaagagttcggcgagtccatgccgtttgacggcaagcgaatgatctatggcggattcgagtcaatcatcgacgaataggtagcgtgacgggctgtgcggcgtgccgtcagcccaaaaattcacaaatgttgctcggcccagcgtaagaaatcttctttcggtaatgccttgctgtagagccagccctgaccgtagtgcacgccatgctggcgtaaccactcttcttgtttactggtttcgattccctccgctaccattttcagtttcagtgtttttgccatttcgatgatatgcggcgtgacatttttatattccagcgcatcaacgaaagatttatcgatcttcagaatgtcgacatccagatcctgtaaataacttaaacttgaataccccgtaccaaaatcatcaagataaatttcatggcccgcctcccggtagcgagaaattatcggggcgctggttttcggatcggcaaactcgcgttcagtgagttcaagcgcgatctgtctgggattaacctgatagtgattgatcatgtcacgcagcaattgcgggattttttccgaggtgagcacgggggattcaagattgatcgaaatatgctgctgtggatgctgacgcagccagtcgcccatatcttcaaagacgcttcttataatcagtagcgtcaatggctcagaaaggcccgtttgctgtgccagcggaataaaactatctggtgacaaccaactaccgtctgtctgcggccagcgcgccagtgcctcagcaccgacaattttgccattggctaaggagacaatcggctgatagtgcacgcaaatatcacgattttcgatagcatcctgcagccgatgatgcggtgactgaatacggcgcaaaatacgcagcacaaacatcgctgccagcaggccaatcaccaacccgagcggtaaccaaataaagacttgccgatgccagcctttctgcaacattttcgttgaagcccatgtgatgatcgaaatattcatctccggtaagggcaggatatcgtaaatgattccattattttcgatatgctcaccgggtgttttttgtagcctggtaataattccctgagcaatttcatcgctgctggttatgacaacgttatgggcattgccaataatggcggcatcaatttgccatgagctatagggaatgacatcaataaaggaagcggggtcgatcatgacgacataatgtgccgttcccatggcgaccatgtaacggataatgcctaaatcgttatgcgatgttaaccagacacgataaccatctttcgaaattttacctggctcggggaaggtatcgggcggactttcatgctccagagacgaacactggggaacgttgttatcgatataagccacttcctgaatatagcgataactgtaagatacccgacgcatttccatgagatgggcttcgctacaggcagcgccttgccatctttccagctcctgcagcgcatctttcccttgtgtcgccaccttattggctcgaatagcgacgcgggaggaataggtatccagctcttcaataaacgatgtttctacctgctgatgggccagccagatgcttaagccgacaggcagcaatactgaaagaatcagtactcccgaaataaggccgaccagatgtcgtgttctcaccagcatatccttattaacacagtgtagggaaagtatatctgattgtggaaaaaggctggctggagataaggaggtagagctggtatttcatgaagtgatgggtggaaacgatcattgtcatttgaccaggcgcagagctttacgcctggtatgtaaccctaacttaagatgttgattcggcgcgagcgagggtaaaaatatcgtaaaaagacagttcacctttacggacgatcattttttgcagttgttccttatgaacatccgcgacacgcggagagttcaagatggcttcaaccagcgcggcaggtacaaagcgcgtgttgtaccattcgccgttatagcaaacgcggaaatccagcacgtcgatatcttcatagcggtagcgtgggtagacatcgaaaaagaagaaaccattaagcaggataaataatacaaccagtagccagacagagcctgacagcgtttcggactgcaacatcaccgccagggtggcaaaaaaagcaacgtacataccgataaacagccccggatgtttacggataaaactgatactaaagcggggtttgttgtcgcgtttttcgcgggtattcagagactcaatcgtttcggtcagcaggcgttgtatttcggtcatcgtttgccttcgtggtatctgcaactttccagggaacaccctattttaacgtgggaatagtagaggggaagtaacagatctaccacaattttgcataacagttgcgaaaaaccgattacaattttttaattattctggctggattaccgcccacgacaacgttgtccgggacatcttttgtgacaactgcacctgaggctaccacgacgttatcaccaatggtcacaccagggttaatgaccgcgcgtccgccaatccagacgttattaccgatggtgacgggtttccccagttcagcaccgctattacgtgctacagggtcgatgggatgtgttgccgtgtagatatgaacgcctggtgccaacatacagttatcaccgatgcgaatagggcagacatcaagcatcacgcaatcgaagttggcgaaaaaattattaccgagaaaaatgttatagccatagtcacagcgaaacgttggctcaatataagcctctgtcacctgaccgaatagatcagcgagaatttgctggcgtaatgtgtgctcttccgccagggaatgattgtatcggtgaataagctgacgagcgcgcaggcgatcgcgagataacgtctcatctgccgagcgatacaactcaccagcaatcatcttttctttttctgtgctcattactgacctccggttgctgaaaatgcggcaacacagtaagacgaaaagtcagtgaagagaacgttcccattacatctgtgtgataaagatcacatagggtatgtcttcatggcgaaaaagtataaaattcttaataaacagccggttatagctccgaaagcgaattatttattagcgaataaatttccatactgaggaagggatcttgtcgtacagtttattcatggtcaattcggcgaggcggtgatctgcggctgagtaaaataccgccagttcattatctgataattcgtatttatttttctcgataacacgctccagcgtgtcaattgtctggcaacgacgtaaacgcattaaataatcggttttcgttaaaggtttttcggacatacttctacctatggttgtaataattctaacaagataaactcgcaggattctctttcgtcgcattgacaaaacaacggaatagtcgattacctgacttccgccatttctgaagatcctgcatattaataccataactactgaacaacataaaggtgtcatccagatattcgtcgatctgctcaatgagcttattgtcttcattatacttaattttgtaattaagtgcgaaggtcgcaatatgctcaatcagttcattcaactggaggttgatcgccgaggttgggtcgtttacccagccatgattgctttcttcaaggtttgcaaggcagtcatgatacagggtttcacagagaaacttaagctgtgcgatatcatgtcttttgggtgagtattcatccataacgcgtccccttcttagcggttgaactaacggacacctttcgggatggaaaaaacttactgacctggacttgccctctcgtttgttagcttaactataagccactctttgcaggttttcatcgcattattacgaaaaattacaattaggaaggaagcgggacaggactcactttttcatactagcactaacccgcagcaggtaaaagcagtttgctcgaactattcataacatttcaggattatcgccagatgaaattggtgacactaataccaggattgctctgaatatgacgtaataaccgaggaatgaataaagaattaccgcaaataattaagaatagcctctaaatgattatggattattaaatctattagcgctacttaatataaattaactaacaatcagtattttttatgaattttatccgtggttaatactggttttcgtatgagatcctgagttggtggttcaattactccttaatgttcgtaggttatgcataaaaaaggccgcttacgcggccttagtgattacacgttgtatcaatgatgatcgacagtatggctgtgctcgatatcttcattcttgcggctaaagcggcggcgaaccaccacaaagaataccggaacgaagaagattgccagtaccgttgcggtcaccatcccgcccattacaccggtacctactgcgttctgcgcgccggaaccagcaccagtactgataaccagcggcataacgccgaggataaacgccagcgaggtcatcaggatcggacgtaaacgcatccgcaccgcatcaagcgtcgcttcaatcagacctttaccttctttatccatcaagtctttggcgaattcgacgataaggatcgcgttcttcgccgacaacccaatggttgtgagcaggcctacctggaagtaaacgtcattggtcaggccacggaaggtggcagccagcaacgcaccgataacccccagcggaacgaccagcataacggagaacggaatcgaccagctctcgtacagcgccgccagacacaggaacacgacaatcaacgaaatcgcgtacagtgaaggtgcctggttgccggagagacgttcctgataggacatccccgtccagtcatagccaacaccggtaggcagtttgctcgccagttgttccatcagctccattgcttcaccggtacttttacccggtgccgcctggcctaagatttccatggatggcaggccgttgtaacgttccagacgcggcgaaccgtactcccaacgagaagaggagaacgccgagaatggcaccatctgaccatcagcagcacgaacataccagtcgccgatatcatccggcagcatacggtatttcgcttctgacatgacataaactttcttcacacgaccgcggtcgataaagtcgttcacatagctgccgccccatgcagcgcccagagtggtgttaatgtcgttgatagaaacacccagcgcctgcgctttttcctggtcgatatcaatcttaaactgcggggtatcttccagaccgtttggacgtacgctggtcaacatatcagggtgcttcgctgcttctgcaagcaactggttacgcgcctgagtcagtttttcgtgaccaaggccagcctggtcaatcagctcaaagtcaaagccggttgcagtacccagttccacgattgcgggcaggttaaaggcgaaaaccatcgcatctttgatttgcgagaaagcgcgtgttgcacgcatggtaatcgcttcaactttgttttcttcgcccggacgatcggcccagtccttcaaggaaacgaacgcaataccggtattctgaccacgtcccgcaaagccgaagccgttaacggcgaacaccgactcaacgttgttcttttctttggtcagatagtaatgcgttacctcattgagcactttctgtgtacgttcctgcgttgcacctgctggcagctgaaccatggtcataaacacgccctggtcctcatctggcaagaaggagcttggcagacgcacgaacagataggccatgccgaccacgatgatcagatacagcaccaggtaacgccccgtactgcgcagaataccgcctacgctgtcggtgtagtggtgcgtgctcttctcgaacatgcggttaaaccagccgaagaagccttttttaccttccccgtgatcgcctttggcaatcggtttcagcatggtggcacaaagagctggagtcaggatcaacgccaccagtaccgacagcgccattgctgaaacaatggtaatagagaactgacgatagatagcaccagtagaaccgccaaagaaggccatcggtacgaataccgccgacagtaccatcgcgataccgaccagagcgccctgaatctgccccatcgacttacgggtagcttcttttggcggcaaaccttcttccgccataacacgctcaacgttttctaccacaacgatggcgtcatccaccaacaggccgatggcgagcaccatcccgaacattgttagcgtgtttatcgagaagccaaaggcggcaaggacggcaaaggtcccgagcaataccaccggtacggcaatggtcggaatcaacgtcgcgcggaagttctgcaggaacagatacataaccaggaacacgaggatgatcgcttcgaccagcgttttaaccacttcgtgaatagagattttcacgaacggcgtggtgtcgtatgggtaaacaattttcagacccgacgggaagaacggttccatcttcgccagttcagcacggattgccgcagcggtatccagcgcgtttgcaccggtcgccagcttgatccccagaccggaagccggttggccgttaaactctgcgatgatgtcgtagttctcaccacccagctcaatcttcgcgacgtcacgcagcagcacgcgggaaccatcctgattcactttcagcaggattttgccgaactcttcagtagaggtcagacgcgtctgagcaataatagaggcgttaagctgttggcctttcaccggcggcgtaccaccgagctgacccgccgcaacctgggcgttctgcgctttgatggcggtaatgacatcaaccggcgttagctggaatttgttcagctcattcgggttcatccagatacgcatcgcgtactgtgaaccgaacaactgaacatcacccacgcccgacgtacggctgatggcatctttcatattcgccgccacgtagtcggagatatcctcctgcgtcatggtgccatcggtgttgataacgccgacaaccatcaggaagctgctggatgatttctcaacgctcaccccttgctgctgaacttcttgcggcagcaacggcatcgccagctgcagtttgttctgcacctgaacctgcgcgatatccgcatcagtaccagactcaaaggtcagggtgatctgcacggtacccgtggagtcactgttagaggacatgtacatcaggttatcgataccgttcatattctgttcgataacctgtgtcaccgtgtcctgcactgttttcgcatcagcgccggggtaggaggcggagatcgttactgccggcggtgcaatcgtaggatattgcgccaccggcagtttgaggatcgccagcccccctgccaacatgatgataatggcgatcacccacgcaaaaatcgggcgatcgataaagaaattaggcatgtcttaacggctcctgtttaagttaagacttggactgttcaggctgagcaccgcttgcggcttgctggttattatcagcggtaacttcttgtgcttttacctggacaccaggacgcactttctgcagcccacttattactacgcgatcgcctgctttcagaccttctgtcaccagccacttatcgccaatagcctggcttgcaacgatcggacgggtttccactttgtcatccgcgccaactaccagtacggtggcatcgccacgcggcgtacgggttacgccctgttgcgggactaaaatagcgtttggattaagcccttcttccagacgtgcgcgcacgaacatacccggcagcagagtgtgatccgggttcgggaagatagcgcgtagggtgatagacccagtggtctgatcaacggtaacgtcagagaattccagcgtaccgtcctgcgggaacttaatgccgtcactggtgatcagtgacactttggctttgccgttctcttgtttcagcgtgccattcgccagttcctgtttcaggcgcaggaagtcgttgctggactgggtcacatcaacgtagatcggatcaagttgctgcacggttgccagcgcagtcgcctgaccgttctgtaccaatgcgccttccgtcacgttcgacttaccaatgcgaccgctaatcggagaggtgactttggtgtaagccagattgatccgcgcagtttcaacggcagctttcgccgcagttaccgcagcattcgcctgttgcgcatcagccagagcctgatcgtactcttgcttactgatgtactgagtaccgagcagtttctgataacgattcaccgtcaattgcgcgatattggctgcagcctgggctttcgccagatcacctttcgcactgtcgtatgtcgcctgataggtcgcaggatcaatctgatagagagagacacctgcttcgatgtcgctaccttctttgaaattacgcttcaggataatcccgctaacttgaggacgaacttctgcgatccggtaggcactggtgcgacccggaagctcggttgtgatctgcagaggttcagttttgactgttactacgccaacggcgggcatctgctggccaccttgttgggcctgtttgtcgtcacatcctgttagggctaagctgcctgagagcatcagaacgaccgccagaggcgtaaaccctctgtttttgttcatatgtaaacctcgagtgtccgatttcaaattggtcaatggtcaaaagttaataaacccattgctgcgtttatattatcgtcgtgctatggtacatacattcacaaatgtatgtaaatctaacgcctgtaaattcacgaacatatggcacgaaaaaccaaacaagaagcgcaagaaacgcgccaacacatcctcgatgtggctctacgtcttttctcacagcagggggtatcatccacctcgctgggcgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgaatccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgttgccatcttactggagatgtatctcctgtgccccacgcttcgtaatcctgccactaacgaataaccctgaatctgactccaggatttttcctggacattttcgtcgttgctattctggttcactgcgtcgtgatattcttgcggtttgactttttcaggtcgttcttcaggttcagaaaccttcattcatcatgactatgttccagtattacaaacgatcacggcattttgttttttcagcatttattgcttttgtttttgtcttgttatgccagaacacggcgtttgcgcgggcgtcatcgaatggtgatctgccgacaaaagcggacctgcaggcgcaacttgactcactaaataaacaaaaagatctttctgctcaggacaaactggtgcagcaggatctgacagatacattagccaccctcgataaaatcgatcgcataaaagaagagacagttcagctacggcaaaaagtcgctgaagcgccggaaaaaatgcgccaggcgaccgcggcgttaacagcacttagcgatgtcgataacgacgaagaaacgcgcaaaattctgagcacgctgtcgttgcgccagctggaaactcgcgttgcccaggcgctggacgatttgcaaaacgcacaaaacgatctggcgtcttataacagccagctggtttcgttacagacgcagcccgaacgcgtgcaaaatgcgatgtataacgcttcgcagcagctgcaacaaattcgcagtcgtctggatgggactgatgtcggcgagacagccttacgtcccagccagaaagtgttaatgcaggcccagcaggcgttgctgaatgcggagattgaccagcagcgtaaaagcctggaagggaacaccgtcttgcaggataccttgcaaaagcaacgtgattacgtgacggcgaacagcgctcgtctggagcaccagttacaactgttgcaagaagcggtaaacagcaagcgcctgactttaaccgaaaaaacggcgcaggaagccgtctccccggatgaagccgcgcgtattcaggctaatccgctggtgaagcaggaactggaaattaaccagcagttaagtcagcgtctgattaccgcgactgaaaacggtaatcagttgatgcagcaaaacattaaagtcaaaaactggctggagcgggcgctgcaatcggaacgcaatattaaagagcagattgccgtcctgaagggcagcctgctgttgtctcgtatcctttaccagcaacaacaaacgctgccctcggcggatgaactggaaaacatgaccaaccgcatcgcggatttgcgtctcgaacagtttgaagttaaccagcagcgtgatgcactcttccagagcgatgcgttcgtcaacaaactggaagaaggtcacaccaacgaagtcaacagcgaagttcacgatgcgttattgcaagtggttgatatgcgtcgcgaattgctggatcaactcaacaaacagttgggtaaccagctgatgatggccattaacctgcaaatcaaccagcagcagttaatgagtgtgtcgaaaaacctgaaatccatcctgactcagcaaatcttttgggtgaacagtaaccgtccaatggactgggactggatcaaagcgttcccgcaaagcctgaaagatgaatttaagtcgatgaaaatcacggtgaactggcaaaaagcctggcccgccgtttttatcgctttcctcgctggtttgccgctgctgttgattgccgggctgatccactggcgtctgggctggctgaaagcgtatcaacaaaaactggcttccgctgtgggttccctgcgtaacgacagccagctcaacacaccaaaagcgatccttatcgacctgatccgtgcgctgccggtgtgcctgattattctcgcggttggcctgattctgttgaccatgcagctcaacatcagcgaactgctatggtcgttcagcaaaaaactggcgatattctggctggtgtttggcctgtgctggaaggtactggagaaaaacggcgttgccgtacgtcacttcggcatgccggaacagcagaccagccactggcgtcggcaaattgtccgcatcagtctcgcattgctgcctatccatttctggtctgtggtggcagaactttccccgctgcatctgatggatgatgtgctggggcaagcgatgattttcttcaacctgctgctgattgccttcctggtatggccgatgtgccgcgaaagctggcgtgataaagagtcgcacaccatgcgactggtcaccattaccgtgctgtcgataatcccgattgcgctgatggtgctgactgctacaggctacttctacactacgctgcgtctggcaggacgctggattgaaaccgtttatctggtgatcatctggaacctgctgtaccagacggtactgcgtggcttaagcgtagcggcgcggcgtatcgcctggcgtcgtgcgctggcgcgtcggcagaatctggtgaaagagggcgcagaaggtgctgaaccgccggaagaacccaccattgcactggagcaagttaaccagcagacgctgcgtattaccatgttgctgatgtttgcgctgttcggtgtcatgttctgggcaatttggtccgatttgatcaccgtgttcagctatctcgacagcatcacgctctggcattacaacggcactgaagctggcgctgcggtggtgaaaaacgtcaccatgggcagtctgttgtttgcgattatcgcctcaatggtggcctgggcgttgattcgcaacctgcctggtttactggaagtgctggtgctctcgcgactgaatatgcgccagggcgcgtcgtatgccattactaccatccttaactacatcattattgctgttggtgcgatgacggtgttcggatcgctgggcgtctcttgggataaactccagtggctggccgcagcattatccgtaggtcttggttttggtttacaagaaattttcggtaacttcgtctccggtttgatcattctattcgaacgtccggtgcgtattggcgatacggtaaccattggtagcttctcggggacggtaagtaagatccgtattcgtgcgacaacgattaccgatttcgatcgcaaagaagtgatcatcccgaacaaagcgtttgttaccgagcgtctgatcaactggtcgttgactgacactactacgcgtctggtgatccgtctcggcgtggcctatggctccgatctggaaaaagtgcgtaaagtgttactgaaggcggcgactgagcacccaagggtgatgcacgaaccaatgccggaagtcttctttacggcatttggtgccagcacgttggatcatgagctgcgtctgtatgtgcgtgaactgcgtgaccgtagtcgtactgtcgatgagctgaaccgtactatcgatcagctgtgccgtgaaaacgacatcaacattgcctttaaccagcttgaagtgcatctgcacaacgagaagggcgatgaggtgacggaagtaaaacgcgactacaaaggcgatgacccgacgccagcggtagggtaaaaacgaaagggggcaacatttagttgccccgagattgctaacaaagtgcgcgttgttcatgccggatgcggcgtgaccgccttatccggcctacgaaaccgcaagaattcaatatattgcaggagcggtgtaggcctgataagcgtagcgcatcaggcagttttgcgtttgcccgcaaccttaggggacatttagcgaccccatttatttctcacttttccgcctcatcatcgcgcgttaatttcttttcataatcacgctttacaatatccagcgcgcgcagcacggtactggcagggatctgattttcctccagcagcacaatcaaatcgacagccagtttgacatcgtcaggggcattttccagtgacatattctctccattgctagcgggttaaacgcgctaacctgttttcgattttttccagcgcatggcggcagcgtgccaggcgcgcttcataggcttccacttcacgatgcagcgtttgctgttccacgagatcggtcacccgcgccagacgggctctgcgttcggcaaccatctcacgtagccgccgctcaaaatcctgatgctgaatacgtttacgctgccagcgggcaattttcggtggtgcactgtcccactcgcgcaatgaccaggcggaggcttcacgcgcgatggcttccagttgtgccgccagatgttccgccagccaggccacttgcggcagctgttgctgctcaactgcatgacgaagcgcagccagattatcgcccgcctcgtcgagacaagcctgtagtgttgtcgcacgagtctgaaaaagatgcctgtcgaaacgagcacttagcgtggcgaactgtgacaccggggcacaacgctgacgcagcgtagcgagctgtccttccagtttttccagcagcagggcggttttcacgataagacctcaatgaaaatgataattgttatgctaaagtagccactctgtaagctgacaacactcaatatgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgtcaaaccgcgggcgattttgcttattttgctcacgtttgccatttctctgtggttcgtccagatgccatgggtgcgcatcatgttgctggtaattctcgcctgtttgcttttctatatgtggcgaattccggtgattgatgaaaagcaagaaaagcactgaagcacaacaatcgcagttgcaattattgcgtacagccagtacattctggcgttttcgagcacaggcgcaggcggtcaaaggttaaacaactgttacttttgatacgtttaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggagatccacgttgatgccatcaaaccgggcgacaaagttctggtggtggacgacctgctggcaaccggcggcactatcgaagcgaccgttaaactgatccgtcgtctgggtggtgaagtggctgacgctgcgttcattatcaacctgttcgatctcggcggcgaacagcgtctcgaaaaacagggcattaccagctacagccttgtcccgttcccgggccattaattatcgccagtcttgtgctgcccacgctacggacagcacaagatgtgcattcagcctcgccgttctgacggggctgtgttagcattaccccttcgtgaatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtggtcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgctgcaattgctggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgtcgcatgggcgttgagatgacgctgctgcgcgcgctggcattccatccgcgtatgccgctgcctgagccagaagtgccacgacagtcctttgcacccgtcgcgccaacggcagtaatgacgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctagcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcatgttaaaaggttcaacggttgaactgactatcgttgaagatgataatcccgcggtgcgtacgccgctggagtggcgtcaggcgatatacgaagaaaaacttgcgcaggcgcgcgagtccattattgcggataataatattcagaccctgcgtcggttcttcgatgcggagctggatgaagaaagtatccgccccatttgatcgtaagcacagcttacgttcgtcatccttaacgtgattgagagagaaacctatgtttggtaaaggcggtctgggtaacctgatgaagcaagcccagcagatgcaagaaaaaatgcagaaaatgcaggaagagatcgcgcagctggaagtcaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtattgaagaaacgcagaaagaaaaaatggcctctgtatcctccggaatgcagctgccgcctggctttaagatgccgttctgatgcaaaccagcccgctgttaacacagcttatggaagcactgcgctgtctgccgggcgttggcccgaagtcggcgcagcgtatggcgttcacgctgcttcagcgcgatcgtagcggcgggatgcgtctggcgcaggcgctcacccgggcgatgtcggaaatcggccactgcgccgattgccgcactttcaccgaacaggaagtctgtaacatctgttcgaatccgcgtcgtcaggaaaacggtcaaatctgcgtggtggagagtccggcggacatctacgccattgagcagacggggcagttttcaggtcgttattttgtgttgatggggcatctgtcaccgctggacggcatcggtccggatgatatcgggcttgatcgtctggaacagcgtctggcagaggaaaaaatcactgaagtgatcctcgccaccaaccccacggttgaaggtgaagctaccgctaactacattgccgagctttgcgcgcaatatgacgtggaagccagccgaatcgctcatggcgttccggttggcggcgagctggaaatggtcgacggcaccacgttgtcacactcccttgccgggcgtcataagattcgtttttaagcaaacgagagcaggatcacctgctctcgcttgaaattattctcccttgtccccatctctcccacatcctgtttttaaccttaaaatggcattattgaggtagacctacatgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgtgcgctctctaacccggacctgtacgaaggtgatggcgaactacgcgttcgtgtctctttcgataaagacaagcgtacgctgaccatctccgataacggcgtggggatgacccgcgacgaagtgattgaccatctggggactatcgctaaatccggtaccaaatcattcctcgaatccctgggttctgaccaggcgaaagacagccagctgatcggtcagtttggtgttggtttctactctgcgtttatcgtggccgacaaagtgaccgtgcgtactcgcgcggcaggcgaaaaaccagaaaatggcgtcttctgggaatcggctggcgaaggtgaatacaccgttgccgacatcaccaaagaagatcgtggtactgaaatcaccctgcatctgcgtgaaggcgaagacgagttcctcgatgactggcgcgtgcgttccatcatcagcaaatactccgaccatatcgcgctgccggtagagatcgaaaaacgcgaagagaaagacggcgaaaccgttatctcctgggagaaaatcaacaaagcgcaggcgctgtggactcgtaacaagtcggaaatcaccgatgaagagtacaaagagttctacaaacacatcgcccacgactttaatgatccgctgacctggagccacaaccgtgttgaaggtaagcaggagtacaccagcctgctgtacatcccgtcccaggctccgtgggatatgtggaaccgcgatcataaacacggcctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtatctctggaagactacgtttcccgcatgaaagaagggcaggagaaaatctactacatcaccgcagacagctatgcggcagcgaagagcagcccgcacctggaactgctgcgtaagaaaggcatcgaagttctgctgctttccgaccgcatcgatgagtggatgatgaactatctgactgagttcgacggtaaaccgttccagtcggtgtctaaagttgacgagtcgcttgaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcagatactgaagatgaagcgaagttcagcgagtgggtagaactgctgctggatcaggcgctgctggcagaacgcggcacgctggaagatccgaacctgtttattcgtcgtatgaaccagctgctggtttcctgatgtaatgccggatgaccttcgtgtcatccggcatttttcttttcatcatctgcactttccgcaaattatctcgccattaaccgtttcagccccaggtgcctttcttgaggcaatcgcctgttggtggtatcgtttatcgctttttcaaaaaattcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaattcgacgtaccggacgaactgatcgttgaccgtatcgtcggtcgccgcgttcatgcgccgtctggtcgtgtttatcacgttaaattcaatccgccgaaagtagaaggcaaagacgacgttaccggtgaagaactgactacccgtaaagatgatcaggaagagaccgtacgtaaacgtctggttgaataccatcagatgacagcaccgctgatcggctactactccaaagaagcagaagcgggtaataccaaatacgcgaaagttgacggcaccaagccggttgctgaagttcgcgctgatctggaaaaaatcctcggctaattcgaaagcgcgcacggacagtcccctcgccccctcggggagagggttagggtgaggggaacaggcccgcacaagcaaacttatcagcaatctcaggccggatattcattcggccttttacaaaaacctcaatctgcgctattcctttttctgatttgacctctcacagcaattagttcttcttcctcacttttccgctacaattatcaacaagttgaatcgataagaggcggtaatgcgtcagactaaaaccggtatcctgctggcaaacctgggtacgcccgatgcccccacacctgaagcggtaaaacgctatctgaaacaatttttaagcgacagacgcgtggttgatacctcacggttgttatggtggccattgctgcgcggcgtgattttgccgctgcgctcgccgcgtgtggcgaagctgtatgcctctgtctggatggaaggtggctcgccgctgatggtttacagccgccagcaacagcaggcgctggcacaacgtttaccggagatgcccgtagcgctgggaatgagctacggctcgccatcactggaaagcgccgtagatgaactcctggcagagcatgtagatcatattgtggtgctgccgctttatccgcaattctcctgttctacggtcggtgcggtatgggatgaactggcacgcattctggcgcgcaaacgtagcattccggggatatcgtttatacgtgattacgccgataaccacgattacattaatgcactggcgaacagcgtacgcgcttcttttgccaaacatggcgaaccggatctgctactgctctcttatcatggcattccccagcgttatgcagatgaaggcgatgattacccgcaacgttgccgcacaacgactcgtgaactggcttccgcattggggatggcaccggaaaaagtgatgatgacctttcagtcgcgctttggtcgggaaccctggctgatgccttataccgacgaaacgctgaaaatgctcggagaaaaaggcgtaggtcatattcaggtgatgtgcccgggctttgctgcggattgtctggagacgctggaagagattgccgagcaaaaccgtgaggtcttcctcggtgccggcgggaaaaaatatgaatatattccggcgcttaatgccacgccggaacatatcgaaatgatggctaatcttgttgccgcgtatcgctaaagctgagcggtaaagaactgagcgccgtcgcgaagagcctcgtcggcggttttcatcatccgtgaataatgcaaaaaggcgtgcagcgtgcctgggtagagtttgaactcacagggctgctgatgcgccgctaacgtctggtaaagcagacggctgtcatccagcagcggatcgaactccgccccggcaataaaacagggcggaacttcgcgagtgagatcattattaaacagacagtaatacggcgactcgcggtccgcgtcgttgcttaaatatgcctcttcgtacatctgcaaatcctgttgcgttaagccatcccagacaccgcccaacagacgacgagtcacggaatcccgtaatccgtaaagcccataccacagcaaaacgcccgcaactttaccgcaatcgatctgtttatcacgcaaccacaacgcactggcgagcgccagcatggcacctgcggaatcaccggcaaagccaatgcgggacatattgatttgataatcctccgcctgctggtggaaataacaacaagcagccacaatttcctctatcgcttgcggaaaacgcgcttcaggtgaaagggtgtaatcaataccaatcaccgtacattggctgtagcttgccagcaggcgcatgatgcgatcgtgggtatcgagattgccgagaataaaaccgcctccatgcaaataaaatagcgtcgctgggctatctggctgcggacaaaagagacgtgtttccacctgcccatattttgttggaaccatgtaagctctggttgccatttctggagcgcccgcattccagaatcggcgctcaagcgtgtaatactgtcgttgctcagcaatcgttcccgttgcgggccagggcggtaaatccggctgaagagtattcacaacggtcttcatttcagcagaaataaggtccagaacaggtagtttgttttccggcttcatacaaaaactcctttcaaattacgtcattgtaaggaaccactgccatgaaaatgcgatcccgcctgctgatattgaaactggctgcgtctcgcgcgctcccgtcagattgtgttaacattcgccgctcagttaaccacccgtaaaaacaaccatgaaatttcccggtaaacgtaaatccaaacattacttccccgtaaacgcacgcgatccgctgcttcagcaattccagccagaaaacgaaaccagcgctgcctgggtagtgggtatcgatcaaacgctggtcgatattgaagcgaaagtggatgatgaatttattgagcgttatggattaagcgccgggcattcactggtgattgaggatgatgtagccgaagcgctttatcaggaactaaaacagaaaaacctgattacccatcagtttgcgggtggcaccattggtaacaccatgcacaactactcggtgctcgcggacgaccgttcggtgctgctgggcgtcatgtgcagcaatattgaaattggcagttatgcctatcgttacctgtgtaacacttccagccgtaccgatcttaactatctacaaggcgtggatggcccgattggtcgttgctttacgctgattggcgagtccggggaacgtacctttgctatcagtccaggccacatgaaccagctgcgggctgaaagcattccggaagatgtgattgccggagcctcggcactggttctcacctcatatctggtgcgttgcaagccgggtgaacccatgccggaagcaaccatgaaagccattgagtacgcgaagaaatataacgtaccggtggtgctgacgctgggcaccaagtttgtcattgccgagaatccgcagtggtggcagcaattcctcaaagatcacgtctctatccttgcgatgaacgaagatgaagccgaagcgttgaccggagaaagcgatccgttgttggcatctgacaaggcgctggactgggtagatctggtgctgtgcaccgccgggccaatcggcttgtatatggcgggctttaccgaagacgaagcgaaacgtaaaacccagcatccgctgctgccgggcgctatagcggaattcaaccagtatgagtttagccgcgccatgcgccacaaggattgccagaatccgctgcgtgtatattcgcacattgcgccgtacatgggcgggccggaaaaaatcatgaacactaatggagcgggggatggcgcattggcagcgttgctgcatgacattaccgccaacagctaccatcgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaagttatcgtcggttcgtaggccagataaggcgttcacgccgcatctggcatttggctctcgatgcctgatgcgacgctggcgcgtcttatcatgcctacatatttttcatattttacatccggcaaccaccgtttaccccgtcaccacctcacccgccggtggcgtttccagcagttccagcatggtacgggcgatttcacgctcgcccatcactacctgattcgcaccacgttcggtgatatacgccacttcatcgtcataatgggcgcgggcaataatctcaatatccggatttttcgcgcgggcagatgccacaatctcacccgcttcataaccgttgggaatcgtcaggatcagccattttgcacattccagatgcgccagttgcataatttcttcgttcgccgcattgcccaatactgcgcggaccccgcgctctcgcagctcatcaacacgggttcgtgacgtctcaatcaccaccagcggaatatcagaggcgagcaatttctcccccagcaggctgcctacacgaccgtaacccaccagtagcgcatggttgcaaatatccactgggatctgcttctcttcttcgattgcctcttccagcgtctgctcttccagcgtttcggtcttcgccagatatttctccagtagtgcgaacagtaccgggttgagcataatcgacaggatcgcccctgccagtaccaggttttgtccggcctgcggcagtaaattcaatgccattcccagtcccgccaggataaacgcgaactcaccaatctgcgccaggctggcggcgatggttaatgccgtacgttgggagtgaccaaacagtcgcaccaggaaaaatgcggctaacgacttaccaaacagaataatcgccagcgtcgccagcactgccagcggttgctgaatcagaattaacggatcaaacaacatcccgacggagacaaaaaacagcaccgcaaacgcgtcgcgcaatggcagcgtatcgtgggcggcacggtgactcagttcagactcgttcagtaccatcccggcaaagaacgcaccgagtgcaaaggagacatcaaacagctctaccgcaccaaaggcaacccctaacgccagcgccagcaccgacagggtaaacagctcgcgagaaccggttgccgcgctgcgtgccataatccacggcaccagacggcgacctaccagcatcataatggcgataaatgcgatcactttgccgatggtgatccccatatcgactgcaagagtggcaaagcccacatcgccctgttccatcattcctgccactgcgggcagcaacaccagcgtcagaaccattaccaggtcttccacaatcaaccaaccgatggcgatttgcccacgctgactgtcaattaattgccgttcttcaagtgcgcgcagtaacaccacggtactggcggtggaaagacataaaccgaacacgataccggtcattaacgaccagcccagcacggcagagagcgccatacccagcagcgtcgccacggctatctgggcgatcgcaccgggaatggcgatggcctttaccgccatcaaatccttcagcgaaaagtgcaaaccgacgccaaacatcaacagaatgacgcccagttcagccagttccggggcaagcttggtatcggcaacaaagcccggagtgaatggtcctgccagcacacccgctaacagatatcccaccagaggagaaatacgtagtttattggccagcatgccgaggataaaggcgagcacaaggccgccaacaatggtggtgataagcggggtggcgtgatgcattccgtctccttttcctggtggttattgtccatttttggccgggaaaaccaaaattacaggtaatagtttatgacaatttcattgatgatgttcatgaataattattgaattttgcagaaaaatggaattagctgcaaaaaaagcacggatcggaaaacagaaggcggtttaacagaggaaaggcttatggcgactgtaaaacgatgcagccaaagtttgcctttggctgcaatgaaatcagtctttatgccggttatcaggcaggaatatggtcaacatccccaatagtggcaggaaagcacagattttatagactaactcgatgctggtgtgatcggcgataagccccagaactgccgctcccagacctcccatgccaaaagcaaaaccgaaaaagagtccagaaaccataccgatacgtcctggaagcagctcctgagcgtagaccagaatggcagagaatgccgaagcgaggataaatccaataatcaccgttaaaacccccgtccagtgcaggctggcgtagggtaaaatcagcgtaaacggcgcaacgccgaggatagagccccaaatcacatatttccgcccaattttatcccctacaggcccgccgatcaccgtacctgccgcaacggcaaacaggaaggcaaacagatgaagctgagcattctggatagataatccgaatttttgcatcagataaaaggtgtaatagctgctgatgctcgccatatagaaatatttcgagaaaatgaggattaacagaatgctgaccgccagtacaactttattgcgcggcagtggattgataatcgtcgctttgggttttcctttattcattcggtgctgtgccgagtaccaacggctgatttgcgccaacaccacgatcgccagcagtgccgcaagcacaaaccaggcaacgttgcctttgccataaggcgcgataatcaccgccgccagcaagggtcccagggaactgccaaagttgccgccgacctgaaagatagattgcgccaggccatgccgcccgccggaagccatacgggccacgcgagaagattccggatgaaagaccgatgaaccggtaccgaccagcgccgccgccagcagaactgcgccaaaactgcccgccagcgcaagcagcaccagaccgcttaaggtaaagcacatgccaattggcaacgaccatggcatcggatatttatcggtccagtagccgaccactggttgcagtagcgaagaggcgagctggaaggtgagggttatcatgccaatctgcataaatgtcagagaaaattctgactgaagcagcggataaatcgccagaatcagcgattggatcatgtcgttcagcagatgtgagaggctgatagcacctaaaataccaaacgatgttcgggccttggtcgttgacgcagccgcgcccgccacaggctggggttgttcactcattgccataggaaagtcactttttcagggttgcgatgtaaagaatgatcttatttgtgattattaccagactaacatacctgtatgcgtcgtctgaaggaagtctcaacgccgaatacagaatttctaatctggatgcagatttatcttcaccggacgcagacttgtctatgatgtcgcgtcatactatttttcaacacgttgaaatcaggtcagggagagaagtatgaaattattgcagcggggcgtggcgttagcgctgttaaccacatttacactggcgagtgaaactgctctggcgtatgagcaggataaaacctacaaaattacagttctgcataccaatgatcatcatgggcatttttggcgcaatgaatatggcgaatatggtctggcggcgcaaaaaacgctggtggatggtatccgcaaagaggttgcggctgaaggcggtagcgtgctgctactttccggtggcgacattaacactggcgtgcccgagtctgacttacaggatgccgaacctgattttcgcggtatgaatctggtgggctatgacgcgatggcgatcggtaatcatgaatttgataatccgctcaccgtattacgccagcaggaaaagtgggccaagttcccgttgctttccgcgaatatctaccagaaaagtactggcgagcgcctgtttaaaccgtgggcgctgtttaagcgtcaggatctgaaaattgccgttattgggctgacaaccgatgacacagcaaaaattggtaacccggaatacttcactgatatcgaatttcgtaagcccgccgatgaagcgaagctggtgattcaggagctgcaacagacagaaaagccagacattattatcgcggcgacccatatggggcattacgataatggtgagcacggctctaacgcaccgggcgatgtggagatggcacgcgcgctgcctgccggatcgctggcgatgatcgtcggtggtcactcgcaagatccggtctgcatggcggcagaaaacaaaaaacaggtcgattacgtgccgggtacgccatgcaaaccagatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctttacactcctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtgcgttttgtacagaccaatatggggcggttgattctggcagcccaaatggatcgcactggtgccgactttgcggtgatgagcggaggcggaattcgtgattctatcgaagcaggcgatatcagctataaaaacgtgctgaaagtgcagccattcggcaatgtggtggtgtatgccgacatgaccggtaaagaggtgattgattacctgaccgccgtcgcgcagatgaagccagattcaggtgcctacccgcaatttgccaacgttagctttgtggcgaaagacggcaaactgaacgaccttaaaatcaaaggcgaaccggtcgatccggcgaaaacttaccgtatggcgacattaaacttcaatgccaccggcggtgatggatatccgcgccttgataacaaaccgggctatgtgaataccggctttattgatgccgaagtgctgaaagcgtatatccagaaaagctcgccgctggatgtgagtgtttatgaaccgaaaggtgaggtgagctggcagtaatccgaaagtgccggatgtttgcatccggcacaatgcttaatcgcggcgggcgatatcagcaaatttggcatcgaggatctttgccagatcgcctgccgccagttcgatatccagtccgcgcttgccgccggaaacataaatagtggcaaattcttgtgcgggggcgtcgataatcgttggcagacgttttttctgccccagtgggctaatccccccaaccaggtatcccgtcgaacgctgcgcgaccatcggatcggccatctcaactttcttggcacccagcgcttttgctacttttttaagatccagttgacctgcgaccggcgtaacggccacggcaaggtgtttcatatcaccgttcactgccaccagcagcgttttgtagacctgatccggattcaaacctaattttttgacgacttcatcgccaaaattggtttcagccggatcgtgctcgtaggtatggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaaaatgaaattcctctttgacgggccaatagcgatattggccatttttttagcgcaacatttgcggcaaattcccttctccatacaggtgtagtgcaccgaccgcgaccacatatcgccccggcggcatggcgcgtaatttatcccgccaggcgagatttcgctgatgcatcagcacatcgtacagcgactgactgaacgtattgggcagcgttatatcattattttgcggcggtgcattcagccaccagctcatcatttgttgcagcaaccgtgcgttggtatgccagtgggtcagcgtatcgtccagcagcgccagtcctttgtcagggagctggagcaacatggcaatctggttttcagccccttccagttcaatcacgggtttatgttgttgcttcgccgcctgcaatagctggtaatcgataccgtattctgcccgcagccccagtttttgtgcctgcgtcgcctgaagaaccatcgcgatttgccacagcggttgggtagaaaagagtgagggagaaatgcccatctcctggctaatgtgctgcaggttttggagttgctcctcgctaatgcgctcttccagcgcctcgcaggcaggcaaattagcaaaaggcgtatcgctggtggaaacatccgcctcgacgatcagcgcatcggcgtttttgagctttttgagcaaacgggtgggcaggggagccatatcgtggctacccatatgaatactgccaatcagatgaaaatggcgattgccggggagggtgatatcgatggcaggccaggtgtaatgattaccgcgcagcgcggcccaaagcgtttttacccggtacaacagatccatacgacctccctttgtgaaatatcatgctagcgcgcggtgagggatggcgcaaatggagttggagacttgtttaatgtgtttgtatgattcagtatgttcttgcatcgctattcacaaggaagcaacagttaaaaaccatgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcactactgagatggcatttcgtctggcgaaagtttttgataccacagtcgatttttggctaaacctccaggcggcggttgatctttgggaagttgaaaacaacatgcgcacccaggaagaattgggacggattgaaacagtggctgaatatttggcacgccgtgaagagcgtgcaaaaaaggtcgcgtaaggccaaaacatcgcttcatctcgtaggccggataaggcgttcacgccgcatccggcatccgagcaccattgcctgatgcgacgcttacccgtcttatcaggcctacaaacttgtgcctgaaccgtaggccggataaggcgtttacgccgcatccggcatccgagcaccattgcctgatgcgacgcttacgcgtcttatcaggcctacaaacctgtgcctgaaccgtaggccggataaggcgtttacgccgcatccggcagtcatgcgtcgatgccaaatgcgccaccctaaagcagcgcatccgcaatgatgtacttattccttcggtttaaaccgcagcaaccggttggcgttactcactacggtaatcgacgagagcgccattgccgctccggcaactaccgggttaagcagtgttccagtgaacggccacaaaataccggcggcgaccggaataccgatactgttgtagataaacgcaccgagcaggttctgcttcatgttgtgcagcgttgcgcgggaaatagcgagcgcatccgcaacgcccatcaggctatggcgcatcagggtaatcgccgcggtttcaatggcaacatcactgccgccacccatcgcaatgccgacatccgcctgagccagcgctggcgcgtcgttaatgccgtcgcccaccattgccacctgacgtccttcactttgcagatgtttgatcgcttcggctttaccgtccggcagcaccccggcgatcacctcatcaatccctgcttctttggcgatcgcattggcggtggttgggttatccccggtcaacatcaccagacgatatcccgctttatgcaggcgttgcagcgccgccacgctatcactacgcaacggatcgcgtactgccagcagggctaccgctttcccgtcaaccgccagcagcacaggcgttgccccttgcgatgcctgagcagtaatctccgcttcgatagctttggtaccaacctgttgctcatttaacagcgcctgattgcccagcaataacgcatgaccttcagcttcaccgctcacgcccagcccgcgcaatgtgcggaaaccgttgacctgcggtagctgcatatcacctgctttatcgaggatcgctcgtgccagcggatggctggaaccttgctccagtgccgccgccagacgcaatgcctgcgcttcatcaacatcagcaaatgttttcactgcgacaacctgcggcttcccttcagtcagcgtcccggttttatcgaacactacagtgtcgagtgtactggcgcgttgcagcgcgtcagcgtcccgcaccagcacgccaaactcagccgcccgcccgacgccggaaataatcgacatcggcgtcgccagccccagcgcacacggacaggcaataatcagtaccgtggtggcaatcaccagggtatagacaatctgcggtgccggaccaaagaaataccagattgccgcactgacaagcgcaataaccaccactaccggcacaaatacggctgagattttatccgccagctgaccgatttctggcttgctgctctgggcctggcgcaccatgcgaatgattcgtgacagcgtagtatggctgccaaccgcactggcacgaaacagcacactgccgtcctgtaccactgtcccggcatggacgctatcgccttcgcctttttgctgcgggattggttcgcccgtcagcatcgcttcatccagccatgcttcgccctgggtaatctcgccatctaccggcacgcgatcgccggtcgtcaggcgcagcaacatacctggctgcacttctgccagaggcacgcttttttcaccttcgtcagtaaccaggcgtgccgtcggcggggttaaatcgagtaacttttccagcgccttagaagaacgctggcgtgcgcgcgcttccagcatatggccgagattgatcagaccgataatcatcgcgctggcttcgtaataaagatgtcgcgcttccatcgggaaccactgcggccacaggttgacgctcatcgaatagagccacgccacgccagtacccagcgccaccagcgtatccatcgtcgccgcaccgttcagcaggcttttccatgcactgcggtaaaaatggccgccggcgaaaaccatcactgccagggttatcaggccgataaccaaccacaggctgcggttgtcagcggtgaccatcatgttatcgccgatcatcccccagaccatcaccgggatacccaccgccagtgcgacaattgcctgccagcggaagcgcttcatcgtagcgacggcggtttcttgctggcgctcgcggcgtttagcgtcatcttcaatcgcttccgcgccgtagcccgctttttccaccgcctgcactaaatcttgtggggaggcactgcccatcaccagcgcagtacgctccgccaggtttacccgtgcctgagtgacgcccggtacgctttgcagcgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgatagacacatccgcctgctcaacatccggacgctgttcaagactttctttcacgcgtttaacgcagtgaccgcaggacaggccgtccagggtcaggtcgatagtttgtgacataaaacactcctttaagacagttttgactggctgtgataaaggttaaaccttccagcaaggggaaggtcaagaaattaataaaccaggcgggtaaaagtccgtaaagattaaaaaatcggctcgatttgcatcaggattagacatttatctctttgttttcctgtagttaagttgcgggtgctaagttaaatcaggatgcctgaaaatcggcaccggggtgaggaattacctcccgcatctataaaaaggagttaacaaaagatgttagatgcaaacaaattacagcaggcagtggatcaggcttacacccaatttcactcacttaacggcggacaaaatgccgattacattccctttctggcgaatgtaccaggtcaactggcggcagtggctatcgtgacctgcgatggcaacgtctatagtgcgggtgacagtgattaccgctttgcactggaatccatctcgaaagtctgtacgttagcccttgcgttagaagatgtcggcccgcaggcggtacaggacaaaattggcgctgacccgaccggattgccctttaactcagttatcgccttagagttgcatggcggcaaaccgctttcgccactggtaaatgctggcgctattgccaccaccagcctgattaacgctgaaaatgttgaacaacgctggcagcgaattttacatatccaacagcaactggctggcgagcaggtagcgctctctgacgaagtcaaccagtcggaacaaacaaccaacttccataaccgggccatagcctggctgctgtactccgccggatatctctattgtgatgcaatggaagcctgtgacgtgtatacccgtcagtgctccacgctcctcaatactattgaactggcaacgcttggcgcgacgctggcggcaggtggtgtgaatccgttgacgcataaacgcgttcttcaggccgacaacgtgccgtacattctggccgaaatgatgatggaagggctgtatggtcgctccggtgactgggcgtatcgtgttggtttaccgggcaaaagcggtgtaggtggcggtattctggcggtcgtccctggagtgatgggaattgccgcgttctcaccaccgctggacgaagatggcaacagtgttcgcggtcaaaaaatggtggcatcggtcgctaagcaactcggctataacgtgtttaagggctgatcatgatgaacacggaaggtaataacggtaacaaacctctcggtctatggaacgtcgtttccatcggcattggggcaatggtgggggcggggatcttcgcgctgctggggcaggctgcattgctaatggaagcctcgacctgggtcgcctttgcttttggcggtattgtggcgatgttttccggttatgcctatgcgcgtctgggggcgagctatcccagcaatggcggcattatcgacttctttcgtcgcggattaggcaacggcgtcttttcgctggcgctctcgttactgtacctgttgacgctggcggtgagcatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtctctgcgccccccagctccggtgcgttcttctcctgtattgggataactttccttgcctatgcgggctttggcatgatggcgaacgcggcggataaagtgaaagatccgcaggtcattatgccacgggcgtttctggtggcgattggcgttaccacgttgctttatatctcgctggcactggttttgcttagcgatgtatcggcattagagttagaaaaatatgccgataccgccgtagcgcaggctgcttctccgctgctcgggcatgtgggttatgtgatcgtcgtcatcggcgctttactggcgacggcttcagccattaacgcgaacctgttcgccgtgtttaacatcatggacaacatgggcagcgaacgcgaactgccgaagctaatgaataaatccctgtggcggcagagtacctggggcaacattattgtcgtggtgttgattatgctgatgacggcggcactgaatttaggctcactcgccagcgttgccagcgccacctttttgatttgctacctggcggtgtttgtggtggcgatccgcctgcgtcatgatattcacgcctcgttgccgattcttatcgttggtacgttggtgatgttgttggtgatcgttggctttatctacagtctgtggtcccagggtagccgtgcgttgatatggattattggctcactcttactcagccttattgtggcaatggtcatgaagcgcaataaaaccgtataacatctctctgtgcgcagtacttcctgtattattgtggtggcggtcgatattcgcactggcaaaaaaacgtgcttgaatatctgttgaaaccctttaacaaagcacaggaggcgttgcgcgaacgatgaacatcagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacggcaggtgggctttaacctggaagagagcggcgagctggtgaatctgtttaacgacccgcagcggcacagcgccgacgtcaaacggcgcacgctggagaaggtggcggagatcgaacgacacattgaggagctgcaatccatgcgcgaccagctgctggcactggcgaatgcctgccctggcgatgacagcgccgactgcccgattatcgaaaatctctccggctgctgtcatcatcgggcagggtgattaagacgagacggctcggatatgtagggttatcccttctatcgcaatgacttcaacatgcgtacctgcaccgagatcctcgctggcgctgacaggccatgaactgtcaccgacgcgcatatgaccgcgcccgttgaccagcggagattccagcacaaaacgtcggccaatcagctgctgcccgcgctggtttaaatgactatcgctgtgcttttgttcgcgcacccgccgcgacaaccatttccaccacagccaggcggcgagcagcgtcaggatggcaaacattaccccttgccactcccaacccagcggcaccagccagaccaccaggccggtaatcaccgctgccacgccgctccacaacaaataaccatttccgcccagcatctcggctgccagcagcaaaccgccgagactgagccagaaaatatgtggatgaacgaccattaactccatcatggctgagtccgtttgttggcgctgtctttcaccagctcggcaatcccggcaatcgaccccatcaggctgctggcctctaatggcatcatcactactttgctgttactggaggaaccgatctgctgtaacgcttcggtgtatttctgcgctacgaagtagttcaccgcctgaatatcaccggaggcgatagcttcagacaccattttggtggcgcgggcttctgcttcggcggaacgttcacgcgcttcagcctgtaaaaacgccgactgacgttcgccttccgctttcaggatttgcgactgtttttcaccttcggctttgaggatttccgcctgacggatcccttccgcttcaagaatgtaagcgcgtttggtacgttccgctttcatctgcgcgttcattgaagagataagctctgccggtgggcgcacgtcgcgaatttcaatacgggtgactttaatcccccacgggttggtggcttcatcgacaatacgcagcaggcgtgagttgatgctgtcgcgctgagagagcatttcgtcaagttccattgaacccagcacggtacggatgttagtcatggtcaggttgatgatcgccagctccagattgctgacttcataagccgcgcgcggcgcgtcaatcacctgaataaagcacacggcgtcgatggtaacgttggcgttatctttcgagataacttcctgggaagggatatcgagcacttgctccatcatattgatcttgcgaccaatgcgatccataaacggcaccaccagactgagccccggctgtaacgttttggtatagcgaccaaagcgttctactgtccactgatagccctgcggtacgattttgacacccgcgccgacaatgaccagcgcgacaaaaatgagaatcgggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagcgatgcaggaaaatagtcctttgcttcagctacaaaacgtaggatatctggcgggtgatgcgaagattcttaataacatcaatttttcgctgcgtgctggcgaatttaagttaattaccggtccttctggttgtggcaaaagtacgctgctaaaaatagttgcttcattgatcagcccaaccagcggaacgttactgtttgaaggtgaggatgtcagcacactaaagccagaaatctaccgccaacaagtctcttactgcgcccagacaccgacgctgtttggcgatacggtatacgataatctgatctttccctggcagatccgtaaccggcagcctgacccagccatttttctcgattttctcgaacgcttcgccttgccggacagcattttgacgaagaatatcgccgagctatctggtggtgaaaaacaacgcatctcattgattcgtaacctgcaatttatgccgaaggttttattgctggatgaaataaccagtgcgctggatgaaagtaataaacataacgtcaatgagatgatccatcgttatgtgcgcgagcaaaatattgccgtgctgtgggtgacacacgataaagacgaaattaatcatgcggataaagtgattacactgcaaccgcatgccggagaaatgcaggaagcacgctatgaactcgcataatattactaacgaatcattagcactggcattaatgctggtggtggtggcaatcttaattagccataaagaaaaactggcgctggagaaagatattctctggagcgtcgggcgagcgataattcagctgattattgtcggctatgtgctgaagtatattttcagcgtggatgatgccagcctgacattattgatggtgttatttatctgctttaatgcggcgtggaacgcgcaaaaacgcagtaaatatattgctaaagcttttatctcatcgtttattgccattacggtcggggcgggaattaccctggcggtgctgattctctcagggtcgattgaatttatcccgatgcaggtgatccctatcgccgggatgattgccggtaacgccatggtagcggtggggttgtgttacaacaatttagggcaacgggtcattagcgaacagcaacagattcaggagaaactgagtcttggtgcgacgccgaagcaggcttcagcgatattgattcgcgacagtattcgcgcggctttaattccgacggtcgattcagcaaaaacggttggcttagtgagtttaccaggaatgatgtccgggctgatatttgccgggattgatccggtgaaggcgattaaatatcagattatggtgacctttatgctgctctcaaccgccagcttgtcgaccattattgcctgctatttaacctatcgtaagttttataattcgcgccaccagttggtggtgacgcaattgaagaagaaatgatgcgatgccggatgcgcagcatcgcatccggcgttgtggttcatgtgccgatcaacggaatatcaatacaacaatgcatacagctggcggcgatacttcgacgccagtgcatcacccgtacccagcgcagcgaggatctcctggaacgttttacgcgtctgaccgtctgcggcggtgagatctttacgcagatgcccgaacagcaactccagcgcctcttcattgcgcccaacctgatgcagttgcagcgccagttgcgtcgccagtgcggcatcttctggattctccgccacctgctgttgcaactgttgaatttccggcgtatcagccgcctgcttcagcagttcgatttgcgccaccagcccctggtagcgggtgtcctgatcctgcaacggaatggttttcagcaccgcttccgcatcttcagaacggttcagcgcaatcagcgtttctgccagcagcaggccgatctccccgttctgattcgacaactgccaggcgtctttcagcaatggcagggcatcggtgtaattgctttcctgcatcagttgcatcgcctgctgcgctttcagctcttcttcgcgcggcagcactttatccagcagggcgcggatcgcctcttccggttgcggcccctggaagccatctaccggttgcccgttctggaacagatacacggtcggaatcgcacgcagaccaaactgcgcggcaatcatctgctccgcgtcgcagtccagcttcgccagaataaattgcccgttgtactgcgccgcgaggctttccagaattggggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttaagcaccattaccgcccaggtcaccagcgtcaccggatagcgcatcttcggcttctcgctaataaaagcatggcgtactttgtccaccaccgcttccggtcccaacgtaaagcgggcggcgatgccgggattttcgactggtttatcactttgcgtctggttgacgttgtcggtgaagcgagtacgaatgggaccgggttcgatcaggctgactttaattccgctgtggcgcagctccatgcgcagtgcatctgaccacgcctccagcgcatatttactggccgcgtaagcgccacgacccggcgtggagattaatcccatcaccgatgatgtcatcacaatacgcccttcaccgtgcggtaacatcgcgggtaacaggcgcatggtgagctggtgtgcgccgaaaaagttggcggaaaactgctgttccatctgcgcacggctgatggtggaaagggggccatacatgccgaatccggcattgttaaagatcccatacagacaattatcggtcagggcgatcacctcgtcggctgcgcgatcaacactttctggtgaatccagatcgatcaacacgccggtaaatcccatgctgttcatgcgctcaacatcatccggtttccggcaacctgccagcacatgaaaaccctggcgttttaattcgagcgcgctttccaggccaattccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaaaatctggcgcagcgtttgctcggtttgctgtggctgaaaaccacgcaaaccgtcattgccgcccagttcaaccagcacccaacgcggctgatgctgtttcagcagagccggaaggcgcgccagtccttgttgcgaggtgtcgccgctgatgctggcattaactaccgacgttttactctgccacttatcattcaacaaggcaggccaggccgcgctggcagacattcgatacccggcgctcaggctatcacccagaatcaataacgtgtccgctgcggcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggcttgatgacggcagcagtggcgaagtgagtctggtgggacaaccgctacataatatggacgaagaagcgcgggcaaagttgcgcgcgaagcacgtcggctttgtttttcagtcatttatgttaattcctacccttaacgcgctggaaaacgtcgagcttccggctctgctgcgcggtgagagtagcgcggaaagtcgtaacggggcgaaagcgttgctcgaacagttagggctgggtaaacgtctggatcatcttccggcacagctttccggcggtgaacagcaacgagtggcgctggcacgagcctttaatggtcgacctgatgtgctgtttgccgacgaacccaccggcaaccttgaccgccagacgggcgataaaattgccgacctgctgttttccctcaaccgtgaacatggcaccacgttgattatggtgacccacgacctgcaactggcggcacgctgcgaccgctgcttacggctggtgaacgggcagttgcaggaggaagcatgattgcacgttggttctggcgcgaatggcgttcgccgtcgctattaattgtctggctggcgctaagcctggcggtggcctgcgtgctggcgctgggcaatatcagcgatcgcatggagaagggcttaagccagcaaagccgtgagtttatggcgggcgatcgggcgttgcgcagttcacgcgaagtgccgcaagcgtggctggaggaagcgcaaaagcgcggcctgaaagtcggcaagcagctgactttcgccacaatgacctttgcaggcgacacaccgcagctggcgaacgtcaaagcggtggatgatatctacccgatgtatggcgatctgcaaactaatccccctggcctgaaaccgcaggcgggcagcgtattgctggccccacgcctgatggcactgcttaacctgaaaacgggcgacaccattgacgtgggcgatgccaccttgcggattgccggagaagtgattcaggaaccggattccggttttaaccccttccagatggctccgcgtctgatgatgaatctggcggatgtcgataaaaccggagccgtgcagccggggagtcgggtcacctggcgttataaattcggcggcaacgagaaccagctcgacggctatgagaaatggttgttacctcagcttaaacccgaacaacgctggtacggtctggaacaggacgaaggcgcgctggggcgatcgatggaacgctcgcaacagttcctgctgctttcggcgcttctgaccttgctgctggcagtggcagcggtggcggtagcgatgaatcattactgtcgcagtcgctacgatctggtggcgatcctcaaaacgctgggggcagggcgagcgcaactgcgtaagctaatcgtcggtcagtggttgatggtgctgacgctttcagccgttaccggtggggccataggcctgttgttcgaaaacgtgttgatggtgctgctcaagcccgttctgcctgctgcactaccgccagccagcctctggccgtggctgtgggcgcttggcaccatgacggtcatctcgctgctggtggggctacgaccatatcgcttgttgctggcaacgcagcctttacgcgtattacgtaatgatgtggtagcgaacgtctggccgctgaagttttatctgccgattgtcagtgtggtggttgtgctgctgctcgccggattaatgggtggcagcatgctgctttgggcggtgctggcgggcgcggtagtactggctttgctgtgcggtgtgctgggctggatgctgctgaatgtacttcgccgcatgacgctgaaatcgctgcctctgcgcctggcggttagccgcctgttacgtcagccgtggtcaacgttaagtcagctttcggcattttcgctctcctttatgctgctggcactgctgctggtgttgcgtggcgatctgctcgaccgctggcagcagcagctacctccagaaagcccgaactactttttaattaacatcgccacagaacaggtagcaccgctaaaagcgttcctcgcggaacatcagatagtcccggaatcgttttatccggtggtgcgggcgcggctgacggcgattaacgataagccgacagaaggtaatgaagatgaggcgcttaaccgcgaactcaatcttacctggcaaaatacgcggcccgatcataatccgattgtcgccggtaactggccgccaaaagccgatgaagtgtcgatggaagaggggctggcgaaacgcttaaacgttgccctcggtgataccgtgacttttatgggcgatacccaggagttccgcgctaaagtgaccagcctgcgcaaagtggactgggaaagtctgcggcctaatttctattttattttccctgaaggggcattagacgggcaaccgcagagctggcttaccagtttccgctgggagaatggcaacggcatgttgacacaactcaaccgccagttcccgaccattagcctgttagatattggcgcgattttaaaacaggtcggtcaggtgctggagcaggtaagtcgggcgctggaagtgatggtggtactggtcaccgcctgcggtatgttgctgttgctggcacaggtgcaggtgggaatgcgtcagcgtcatcaggagctggtggtgtggcgcacactcggtgcggggaaaaaactgctgcgtaccacgttgtggtgtgagttcgccatgcttgggtttgtttccggcctggtggccgcaattggtgcggaaacggcgctggcagtgttgcaggcgaaagtgtttgattttccgtgggagccagactggcgattgtggattgttctgccgtgcagcggagcgctgctgctgtcgcttttcggcggctggctgggtgcgcgactggttaagggtaaggcgctgttcaggcagtttgcggggtgatgagagtaaataaggggcgttctggttgaatggaacgccttgtttaaattaattctacaatatgtttcattgatgatgttattgaattggtgatttcctatctttctattgctgatattaatctgaatcggtggagtttattgattttaaatatagccctacaaaaataactcagactaataaaatcataaatcatatgcgttgaatggatattatccatatagtgaatttgttgatgatgaattcatctgtgctaaaaatgttagtttaataaaatattgaaagtgacctgtaataacagttgttgttgattgagaacaaataagtttatgtgaaaaatatataaatacattagctggtcttgtgtgtcattttatttttttttgttgctaacacagggatatgaacaataactaaaagggcactttatatgagcggaaaaccagcggcgcgtcagggagatatgactcagtatggcggtcccattgtccagggttcggcaggtgtaagaattggcgcgcccaccggcgtggcgtgctcggtgtgtccgggcgggatgacttcgggcaacccggtaaatccgctgctgggggcgaaggtgctgcccggcgagacggaccttgcgctgcccggcccgctgccgttcattctctcccgcacctacagcagctaccggacgaagacgcctgcaccggtgggcgttttcggccccggctggaaagcgccttctgatatccgcttacagctacgtgatgacggactgatactcaacgacaacggcgggcggagcattcactttgagccgctgctgccgggggaggcggtgtacagccgcagtgagtcaatgtggctggtgcgcggtggtaaggcagcacagccggacggccatacgctggcgcggctgtggggggcgctgccgccggatatccggttaagcccgcatctttacctggcgaccaacagcgcacaggggccgtggtggatactggggtggtctgagcgggtgccgggtgctgaggacgtactgccagcgccgctgccgccgtaccgggtgcttaccgggatggcggaccgcttcgggcggacgctgacgtaccggcgtgaggccgccggtgacctggccggggaaatcaccggcgtgacggacggtgccgggcgggagttccgtctggtgctgaccacgcaggcgcagcgtgcggaagaggcccgcacctcttcgctatcttcttctgacagttcccgccctctctcagcctcagcgttccccgacacactgcccggtaccgaatacggccccgacaggggtatccgcctttcggcggtgtggctgatgcacgacccggcatacccggagagcctgcccgctgcgccactggtgcggtacacgtatacggaagccggtgaactgctggcggtatatgaccgcagcaatacgcaggtgcgcgctttcacgtatgacgcgcagcacccgggccggatggtggcgcaccgttacgcgggaaggccggagatgcgctaccgctacgacgatacggggcgggtggtggagcaactgaacccggcagggttaagctaccgctatctttatgagcaggaccgcatcaccgtcaccgacagcctgaaccggcgtgaggtgctgcatacagaaggcggggccgggctgaaacgggtggtgaaaaaagaactggcggacggcagcgtcacgcgcagcgggtatgacgcggcaggaaggctcacggcgcagacggacgcggcgggacggaggacagagtacggtctgaatgtggtgtccggcgatatcacggacatcaccacaccggacgggcgggagacgaaattttactataacgacgggaaccagctgacggcggtggtgtccccggacgggctggagagccgccgggaatatgatgaaccgggcaggctggtatcggagacatcgcgcagcggggagacagtacgctaccgctacgatgacgcgcacagtgagttaccggcgacgacaacggatgcgacgggcagcacccggcagatgacctggagccgctacgggcagttgctggcgttcaccgactgctcgggctaccagacccgttatgaatacgaccgcttcggccagatgacggcggtccaccgcgaggaaggcatcagcctttaccgccgctatgacaaccgtggccggttaacctcggtgaaagacgcacagggccgtgaaacgcggtatgaatacaacgccgcaggcgacctgactgccgttatcaccccggacggcaaccggagcgagacacagtacgatgcgtggggaaaggcggtcagcaccacgcagggcgggctgacgcgcagtatggagtacgatgctgccggacgtgtcatcagcctgaccaacgagaacggcagccacagcgtcttcagttacgatgcgctggaccggctggtacagcagggcggctttgacgggcggacgcaacgttatcattatgacctgaccggaaaactcacacagagtgaggatgagggacttgtcatcctctggtactacgatgaatcggaccgtatcactcaccgcacggtgaacggcgaaccggcagagcagtggcagtatgatggccacggctggctgacagacatcagccacctgagcgaaggccaccgtgttgccgtccactatggctatgacgataaaggccgcctgaccggcgaatgccagacggtggagaacccggagacgggggaactgctgtggcagcatgagacgaaacacgcatacaacgagcaggggctggcaaaccgcgtcacgccggacagcctgccgccggtggagtggctgacgtatggcagcggttacctggcgggaatgaagctgggcgggacgccgctggtcgagtatacgcgggacaggctgcaccgtgagacggtgcgcagcttcggcagcatggcaggcagtaatgccgcatacgaactgaccagcacatacacccccgcaggccagttacagagccagcacctgaacagcctggtatatgaccgtgactacgggtggagtgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagctcatctttatcactgcgaccaccggggactgccgctggcgcttatcagcgaagacggcaatacggcgtggagcgcggaatatgatgaatggggcaaccagcttaatgaggagaacccgcatcatgtgtatcagccgtaccgtctgccagggcagcagcatgatgaggaatcagggctgtactataaccgtcaccggtactacgatccgttgcaggggcggtatattactcaggacccgatggggttgaaagggggatggaatttatatcagtatcctttaaatccactacaacaaattgaccctatgggattattgcagacttgggatgatgccagatctggagcatgtacggggggagtttgtggtgttctttcacgtataataggaccaagtaaatttgatagtactgcagatgctgcgttagatgctttgaaagaaacgcagaatagatctctatgtaatgatatggaatactctggtattgtctgtaaagatactaatggaaaatattttgcatctaaggcagaaactgataatttaagaaaggagtcatatcctctgaaaagaaaatgtcccacaggtacagatagagttgctgcttatcatactcacggtgcagatagtcatggcgattatgttgatgaatttttttcaagtagcgataaaaatcttgtaagaagtaaagataataatcttgaagcattttatctcgcaacacctgatggacgatttgaggcgcttaataataaaggagaatatatttttatcagaaatagtgtcccgggattgagttcagtatgcataccgtatcatgattaattttagtgcttttattagtggggcctataaggagattcaatgaaatatagttcaatattttcgatgctttcattttttatactatttgcctgtaatgagacagctgtttacggttctgatgaaaacattatttttatgaggtatgtggaaaaattacatttagataaatactctgttaaaaatacggtaaaaactgaaacaatggcgatacaattagctgaaatatatgttaggtatcgctatggcgaacggattgcagaagaagaaaaaccatatttaattacggaactaccagatagttgggttgttgagggagcaaagttaccttatgaagttgcgggtggtgtatttattatagaaattaataagaaaaatggatgtgttttgaatttcctacatagtaaataatgctggcgctgatggatgcggatggaaacattgcgtggagcggggagtatgatgagtggggcaaccagctgaatgaagagaacccgcatcacctgcaccagccgtaccggctgccggggcagcagtatgataaggagtcggggctgtactacaaccggaaccggtactacgatccgttgcaggggcggtatatcactcaggacccgatagggctggaggggggatggagtctgtatgcgtatccgctgaatccggtgaatggtattgatccattagggttaagtcccgcagatgtagcgctaataagaagaaaagatcaactaaaccatcaaagagcatgggatatattatctgatacttatgaagatatgaagagattaaatttaggtgggactgatcaatttttccattgtatggcattttgtcgagtgtctaaattaaatgacgctggtgttagccgatcggcgaaagggctgggttatgaaaaagagattagagattacgggttaaatctgttcggtatgtacggcagaaaagtaaagctatcccattctgaaatgattgaagataataaaaaagacttggctgtaaatgaccatgggttgacatgtccatcaacaacagattgctcagatagatgtagtgattatattaatccagagcataaaaaaacgataaaggctttacaagatgctggctatctcaagtaatctatcaaagatgataatatttatttttgctattataatcattgttgttttatgcgtaattacttatctttatttatacaaagatgaatctcttgtaagtaaacattacataaactatatggcaataccagaaaatgatggagtttttacatggctcccagatttttttccgcacgtagcggtggatatatcaatatacacaaatgtagaagatgattatttttttcttatttttccctaacaaatgatgatgggggtaggtttaagaaaacattgacagtgagggccagggaacaagtggcgaaaatcgtatcaaagaatgatccagatacaaaaaaagtgtggtgtaaatatggtaagataccagggcaaggggatggtgtaaaccttttttttgttggtgaaattaatgttacgcattattttataacaaatattggagctggattgcctgatgcttgtgcagagtaattgcttgaattaagagtctatcccatatcgaagtcgtcaacttcgtagtgaggaaaagtaaaattcctgactgagaaaagacatgtcggctattgtgtaaagccatatagctcagacgatgaatatctactcgtattcagttgtttattgagggtgagttccgaccctgaaacaacaaataaaatgaacagtcagagagtttacatagaattgcactggtcttttacgatatctgacattgtgtaatacatattcagccatgcattaattaaaatgttacgtgtttaatgtgagtccctatctgaaaataaataatccttccggattaaaataaattcttgccgggaaagaaagaggaaataaaccattagcggaaaaccagcggcacgccagggtgacatgccccagtacggcggcccgatagtccagggttcagcgggggtactgatagtcgcgccgactgcatcgagaactccatacaactttttacggaacgtcacctgataaaatttgttcagtatcgtcttttgagattctcaaggttatggagtaaccagacagaacggacaccactgtcggagataaaaaccccctgtttacgcagctcgttgctggcccggtgctgaccatgtgtcgggaaagcgacggcgtaatcaacaacagcctgttcagttgcctcatcggtacggttcttaaggttaggagcgcggcgactacgattaatctgcgcatccacaccgccttcagcgaccagttcgcggtaacgataaaacgtatcacgcgaaacgcccatgattttacaggcttttgatacgttgctgagttcttcagccagattgagcaaaccggctttgtgtttgatgacgggattggcagtatgaagcatgagagttacctcttgttttggataaggattcgacactcatatcaaaaccggtaactctcaacctttcaaggccatgtgtcagatcaagtcgcgactaatacaaatacgtccctcattaccgcgccttaacccattccgccacttccgcccactcaccgcgaaagacaactttttccgcttttttctcaagctgatagcgatacatcgggtcgtaatattcttcaagtaacggcaccagccaggccagatgaccgtcggtgctgccggtggtgagttgcgttgtcagtgctgcatccagccttgcagccagttcgttatagcgctgtagccccagccgacgcttaatcgccgaaagtccgtgatgcaggtattcgcaatactcctgccagccctgttcgtcgccgtacgcgtgggtaaaatcatgatgcatacgcaagaaatactcttcgttcaggcgctcaagacggatctcaaacggatcttctaccaccgcaatcgccgcctgagtcattcgctcgcgcaggcattccggcaggtgattcgaaccgatcatccggctttcgtcttccagcacccacaggcgcaaattctgacgggcgtcggtttttagcatttcggcagccagcaggttttcaaaactcgcctggctaagttgtggttgtaacgtgcgaccaaacgccgaaccgcgatgacgcgccaacccttccagatcaacaccgttcggctgttgctgcactaacagcgttttaccgctgccggtacaaccgccaatcagcactatcggtttttgtgccagttcaatagtcgcctgaatcgcggtctggcgcagtgccttataaccgccttccaccagcggataatcaatccccgctgcatgcaaccagctttgcacaatatgtgagcgctgaccgccacgggcgcagcagagaataccttgcggattttgcaggcacgctgcccgccaggcgtccatgcgctgctgacgaatttcacccgccaccagtttatgtcccagcgccagcgctgcgtctgagccttgctgtttatagcaggtgccaacggcggcgcgttcatcgttattcattaacggcagattgatagcggcgggcattgcgccgtgctcaaactcgataggggcgcgaacatcaataatgggcgtatcagcaatcagcagggcacgatagtcctgttccgtgtgtctctcttgcatagttaaaagtgaacctcaaatcagcttgcgcgctattttacgcgccaacgcgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgatcattgactggcaaagcgattttggcaaaaaaccaatgccaacgcccgccagatgggcggcgattttcgtttccatatcgggaacaataatctctttttgccctggcaatcgccaggcgacgcgtttggttaaggtgcgggcgctgtcttcaatattgaccgccggaaagcgccgcaactgcgcttctgttagcggctcttcaacgttcgccagcggatgatccgccgccatgacaaagcgccattgcaccgatcctaagggatcaagactaaaggtatttgccagcgcctcagttcccgtgacgccgatagccagcgaaaaaccttcgtacaatagcgagtcccagacgcccatatagatttgtcgggagatgtgaaactgggtaaaggggtaacgctcattcagccacgccagcaactgggcgacggcctgggggttgtagagcaggttgttgatgacaatattcacctggcgttccacgccatcattcacctgttgcagctcgcttggcatactttccagccagctcagccagtctctggcctgggaaagtagatgctcgccagccgctgtcaacgtcacgctgcgagtcgtacggaaaaacagcgctactccggtattctcttccagaagtttaatgcgataactgatcgtcgccgtggttttacataatcgttctgccgcttttgaaaaacttcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatctagttttggaaaaatattccaacttttgtattgatgttgttctcttaaggttttagattgcctgttattgaaaccaagctgaccggtcggcggtggttgaacggaattatgttacaaggacaaaaagatgaaacttcaggtattaccgttaagtcaggaagcctttagtgcttatggcgacgtaatcgaaacgcagcaacgggattttttccatattaacaatggcctggtggagcgttaccacgatttggcgctggttgagattcttgagcaagactgtacgcttatcagcattaaccgcgcgcaaccggcgaatctgccgctgaccattcacgaactcgaacgtcatccgctgggtactcaggcctttatcccgatgaaaggtgaggtgtttgtggtggtcgtggcgttaggtgacgacaaaccagacctgtcaacgctgcgggcgtttatcaccaacggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaactaattgttcattgtttatgctcacttgtaggtcggagttaacgtaggtatgacggaagttagacggcgcggcaggccaggacaggcggagcctgtggcacagaagggcgcacaggcgttagagcggggaattgcgattctgcaatatttggaaaaaagtgggggaagttcgtcggttagcgatatttctctcaatctggatttgccgctctccacgacctttcgcttgctgaaggttttacaggcagcggattttgtctatcaggacagtcaattaggctggtggcatataggattaggtgtctttaacgtcggtgcggcgtacatccataaccgcgatgtcctctccgtcgccgggccgtttatgcgccgcctgatgttactttccggcgaaacggtcaatgtcgcgatccgtaacggcaatgaagcggtattaattggtcagttagagtgtaaatcgatggtcaggatgtgtgcgccactgggcagtcgtctgccactgcatgcttccggtgcgggcaaagcgctgctttatccgctggcggaagaggagttgatgagcatcattctgcaaaccggtttgcagcagtttacgccaactacgcttgtggatatgcccaccttgctgaaggacctggaacaagcgcgtgaactgggctataccgtagataaagaagagcatgttgtaggtctgaattgcatagcttcagcaatttacgatgatgtcggtagtgttgttgccgctatctccatctccgggccttcatcaagactgacagaagatcgttttgtcagtcagggtgagctggtcagagacaccgcccgcgatatcagcacggcgttgggactgaaagcacatccataatgtctgtcgcatcccgctctgcggagcgggtttttttgacaaaatttgaaagttggaaaaattttccaataaatagaggtaggaataaaatggcaaaaatgagagccgttgacgcggcaatgtatgtgctggagaaagaaggtatcactaccgccttcggtgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcttctgctgattccattcctattctgtgcattaccggccaggcaccgcgcgcccgtctgcataaagaagattttcaggccgtagatattgaagcaattgctaaaccggtcagcaaaatggcggttacagttcgtgaagcggcgctggtgcctcgcgtgctgcaacaggcatttcacctgatgcgttctggtcgtccgggtccggtactggtggatttaccgttcgacgttcaggttgcggaaatcgagtttgatcctgacatgtacgaaccgctgccggtctacaaacctgctgccagccgtatgcagatcgaaaaagctgtagaaatgttaatccaggccgaacgtccggtgattgttgccgggggcggggtaattaatgctgacgcagctgcactgttacaacagtttgctgaactgaccagcgttccggtgatcccaacgctaatgggctggggctgtatcccggacgatcatgaactgatggccgggatggtgggtctgcaaaccgcgcatcgttacggtaacgcaacgctgctggcgtctgacatggtgtttggtatcggtaaccgttttgctaaccgtcataccggctcggtagagaaatacaccgaagggcgcaaaatcgttcatattgatattgagccgacgcaaattggtcgcgtgctgtgtccggatctcggtattgtctctgatgctaaagcggcgctgacactgctggttgaagtggcgcaggagatgcaaaaagcgggtcgtctgccgtgtcgtaaagaatgggtcgccgactgccagcagcgtaaacgcactttgctgcgcaaaacccacttcgacaacgtgccggtgaaaccgcagcgcgtgtatgaagagatgaacaaagcctttggtcgcgatgtttgttatgtcaccaccattggtctgtcacaaatcgctgcggcacaaatgctgcatgtctttaaagaccgccactggatcaactgtggtcaggctggtccgttaggctggacgattccggctgcgctaggggtttgtgccgctgatccgaaacgcaatgtggtggcgatttctggcgactttgacttccagttcctgattgaagagttagctgttggcgcgcagttcaacattccgtacatccatgtgctggtcaacaacgcttatctggggctgattcgtcagtcacaacgcgcttttgacatggactactgcgtgcaactcgctttcgagaatatcaactccagtgaagtgaatggctacggtgttgaccacgtaaaagtagcggaaggtttaggttgtaaagctattcgggtcttcaaaccggaagatattgcgccagcctttgaacaggcgaaagccttaatggcgcaatatcgggtaccggtagtcgtggaagttattctcgagcgtgtgaccaatatttcgatgggcagcgaactggataacgtcatggaatttgaagatatcgccgataacgcagcggacgcaccgactgaaacctgcttcatgcactatgaataagggagataaataatgttacgtttctctgctaatttatcgatgttatttggagaatatgattttctcgcccgttttgagaaagctgcgcagtgtggttttcgcggcgttgaatttatgtttccttatgactacgacattgaagaattaaaacatgtgctggcgagtaataaactcgaacatacgctgcacaatttaccggcgggtgactgggcggcgggggagcgcggtattgcctgtattcctggccgtgaagaagagtttcgggatggcgtagcagcagcgattcgttatgcccgtgcgctgggtaataaaaaaattaactgtctggtcggtaaaacgccggctggtttcagcagtgaacagattcacgcaacgcttgtagaaaacctgcgttatgccgcgaatatgctgatgaaagaagatattttattactgattgaacctattaaccattttgatattcctggtttccatctcaccggaactcggcaggcgctgaaattgattgatgatgttggttgctgcaatttgaaaattcagtatgacatttatcatatgcagcggatggaaggtgaattaaccaacaccatgactcagtgggctgataaaattggtcacctgcaaattgccgataatccgcatcgcggcgaaccgggaaccggagaaattaattatgattatctctttaaggtaatcgaaaattctgactacaacggttgggttgggtgtgaatataaaccccaaaccaccacggaagccggtttacgctggatggatccgtaccgttaaaacgtaacgctattcagacaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgtgccggtcatcaattacatgtcacgaccattggaccggttgctgatgaattactgtcactgggtgccgtcagtgttgaaactgctcgccaggtaacggaagcatcggacatcatttttattatggtgccggacacacctcaggttgaagaagttctgttcggtgaaaatggttgtaccaaagcctcgctgaagggcaaaaccattgttgatatgagctccatttccccgattgaaactaagcgtttcgctcgtcaggtgaatgaactgggcggcgattatctcgatgcgccagtctccggcggtgaaatcggtgcgcgtgaagggacgttgtcgattatggttggcggtgatgaagcggtatttgaacgtgttaaaccgctgtttgaactgctcggtaaaaatatcaccctcgtgggcggtaacggcgatggtcaaacctgcaaagtggcaaatcagattatcgtggcgctcaatattgaagcggtttctgaagccctgctatttgcttcaaaagccggtgcggacccggtacgtgtgcgccaggcgctgatgggcggctttgcttcctcacgtattctggaagttcatggcgagcgtatgattaaacgcacctttaatccgggcttcaaaatcgctctgcaccagaaagatctcaacctggcactgcaaagtgcgaaagcacttgcgctgaacctgccaaacactgcgacctgccaggagttatttaatacctgtgcggcaaacggtggcagccagttggatcactctgcgttagtgcaggcgctggaattaatggctaaccataaactggcctgatacccgcaataaaaatggccgatatcagaaaatgaatcggccagcaatattaaaaaagaaagcagccaaagatgttgcttcagtattaaaaataatatttttattttatttgttcctcatagctagattaaaacaacgttattcgatacgtgaaattaagagggatttatggaacatcagagaaaactattccagcaacgcggctatagcgaagatctattgccgaaaacgcaaagccagcggacctggaaaacatttaactattttaccttatggatgggttcggttcataacgttcccaattatgtgatggtcggcggcttttttattctcggcttgtctacctttagtattatgctggcaattatcctcagcgcctttttcattgccgcggtaatggtattaaacggtgctgcgggcagtaaatacggtgtgccttttgccatgatcctgcgtgcttcttacggtgtacgtggtgcactgtttcccggattattaaggggcggaattgccgccatcatgtggtttggtttgcaatgttacgcggggtcactggcctgcttgattctgattggcaaaatctggccgggatttttaactctcggtggtgatttcactctgttaggcctttctctaccgggcttaattactttcttaatcttctggctggtcaacgttggtataggttttggcggtggcaaagttttaaataaattcactgccattcttaacccgtgcatctatatcgttttcggcggtatggcgatttgggcgatttcactggtcgggatcggtccaatctttgactacattccgagcggtattcagaaagcagaaaacggtggcttcctgttcctggtggtgattaacgcggtagttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcactacggcgctgatacctggaacgtgctggatattgttcagcgttgggacagcctgttcgcctcgttctttgcggtactggttattctgatgacaactatctccactaacgcgaccggtaatattattccagccggttatcagattgccgccattgcaccgacaaaactgacctataaaaacggcgtactgattgccagtattatcagcttgctgatctgcccgtggaaattaatggaaaatcaggacagcatttatcttttcctcgatattatcggcggaatgcttggtccggtaattggtgtcatgatggcgcattattttgtggtgatgcgcggacaaattaatcttgatgaactgtataccgcacctggcgattataaatattacgataacggttttaacctcactgcgttttcagtaactctggtggccgttattttatctcttggcggtaagtttattcactttatggaaccgttatcgcgtgtttcatggtttgtcggcgtcatcgtcgcctttgcggcctacgccttattaaagaaacgtacaacagcagaaaaaacaggagagcaaaaaaccataggttaattaatcccgatattgaacattgagttaaaaaccaatctgtattttacaaggagtttgttatgtcttttgatttaatcattaaaaacggcaccgttattttagaaaacgaagctcgcgttgtagatatcgccgttaaaggcggaaaaattgctgctatcggtcaggatctgggcgatgcaaaagaagttatggatgcgtctggtctggtggtttcgccgggcatggttgatgcgcacacccatatttctgaaccgggtcgtagccactgggaaggttatgaaaccggtactcgcgcagcggcaaaaggtggtatcaccaccatgatcgaaatgccgctcaaccagctgcctgcaacggttgaccgcgcttcaattgaactgaagttcgatgccgctaaaggcaagctgactattgatgcggcacaactcggtggcctggtgtcttacaacatcgaccgtctgcatgagctggatgaagtgggcgttgtcggcttcaaatgcttcgttgcgacctgtggcgatcgcggtatcgacaacgacttccgtgatgtaaacgactggcagttcttcaaaggtgcgcagaagctgggcgaactgggtcagccggtgctggtgcactgcgaaaacgcgctgatttgtgacgaactgggcgaagaagcgaagcgtgaaggtcgcgtaaccgctcatgactatgtggcttcgcgtccggtatttaccgaagtggaagcaattcgccgcgtactgtatctggcgaaagttgctggttgccgtctgcacgtttgccacgtcagcagcccggaaggtgttgaggaagtgactcgtgcacgtcaggaaggtcaggacgttacttgtgaatcctgcccgcattactttgtactggataccgatcagttcgaagaaatcggtactctggcgaagtgttcaccgccgatccgcgatctggaaaaccagaaaggcatgtgggaaaaactgtttaacggtgaaatcgactgcctggtttccgaccactctccatgcccgccggaaatgaaagccggtaacatcatgaaagcatggggcggtatcgccggtctgcaaagctgcatggacgtgatgttcgatgaagcggtacagaaacgcggtatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtaccattggcgcgcgtatcacgaaaaccatcttacgtggtgatgtgatttacgacattgaacagggcttccctgttgcgccgaaaggtcaatttatccttaaacatcagcagtaatctggcccctgcaatgcccgtccttgcggcgggcattctccggttaaggtgtgtttatgttcaattttgcagtcagccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttttgcggtcatcgtcgcgctattatggaagggccaggtggcctgtggtggggaaccatccttactatcacccttggtgaagcatcgcgcgggacaccgatcaacgatatcgccaccagcctggcagtggggattgcactctccggcgtgctgacgatgttgattggttttagcggattaggccatcgcctggcacggttatttacgccgtcggtgatggtcttgtttatgttgatgctgggcgcgcagctgaccactatctttttcaaaggtatgctcgggctgccgtttggcatagccgacccgaattttaaaattcagttaccgccgttcgcgctctcggtggcggtgatgtgcctggtactggcgatgattatcttcctgccgcaacgttttgcccgttatggcctgctggtcggcaccataaccggctggttgttgtggtacttttgctttccttcttcgcactcgctctccggtgagttgcactggcagtggttcccgctcggcagtggcggtgctttgtcgccgggaattattctgacggcggtgattacaggtctggtaaatatcagcaatacctacggtgcgattcggggcacggatgttttttatccgcagcagggcgcagggaatacgcgttatcgtcgtagctttgtggcgaccggatttatgacgctgataaccgtaccgctggcggtaattccattttcaccgtttgtttcatccattggtttattaacccagactggcgattacacgcggcgttcgtttatttatggcagcgttatttgcctgctggtggcgctggttcctgcactcacgcgactgttttgcagtatccctttacccgtgagtagtgcggtcatgctggtttcttatctgcctttactcttttccgcgctggtgtttagccagcaaataacgtttaccgctcgcaatatttatcgactcgcattgccgttatttgtcggcatatttttaatggcattaccgcctgtgtatctgcaagaccttccattaacgcttcgtcctctgctcagtaacggcttattggtcgggattttactggctgttcttatggataaccttattccgtgggaacgcatcgaataatttgttgaaaaaggattgataatgaagattgtcattgcgccagactcttttaaagagagcttaagtgcagaaaaatgttgtcaggcaattaaagccgggttttcgaccctctttcccgatgcgaactatatctgtttgccgatagcggatggcggcgaagggacggtggatgcgatggtcgccgcgacgggcggcaacatcgtgacgcttgaagtctgcgggccgatgggcgaaaaagtgaatgctttttatggccttaccggcgacgggaaaacggcggtgattgagatggcggcagcaagtggcctgatgctggtcgcgcctgaaaagcgtaatccgttgctggcctccagttttggtacgggggagttaattcgtcatgcgctggataacgacattcgccatattattctcggcattggcggcagtgcgacggtcgacggcggtatgggcatggcgcaggcgctcggtgtgcgtttccttgatgccgacggtcaggcgctggcggcaaacggtggtaatttagcgcgcgtggcaagcattgagatggatgaatgcgatccgcgtctggcgaattgccatattgaagtagcatgtgacgttgataacccgctggtaggggcacgcggcgcggcggcggtgtttggcccgcaaaaaggggcaacgccggagatggtcgaagaacttgaacaggggctgcaaaattacgcccgtgttttacaacagcaaactgaaattaatgtctgccagatggcgggcggcggcgctgcgggcggtatgggtattgcggcggcggtatttctcaatgcggatattaaaccgggcattgaaattgtgttgaatgcggtcaatcttgcgcaggcagtgcagggcgcagcactggtgattaccggggaagggcgcatcgactcgcaaacggcaggcggtaaagcgccgctgggtgtggcgtcggtggcgaagcagtttaatgtaccggtgattgggattgctggcgtattgggtgatggcgtggaagtggtgcaccagtacggcattgacgcggtattcagcattttgcctcgtctggcacctttagccgaagtgctcgccagcggtgaaaccaatctcttcaacagcgcgcgaaatattgcctgcgccattaaaataggtcagggaattaaaaactaacccttacctttaaagcggatgcgatttatatcgcataagagtgcagtactcatgccggatgcggcatgagtaccatatccttcctgaaaatcgcgcaaattctatatattgcagagatcatgtaggcctgataagcgaagcgcatcaggcaatgttacaaaaaaagccacggtataaaccgtggcaaaatccaacatagctaaaaataatcaggcgagtggtatgacttaaatctctacgtcgcggttacaatctttcgagtaaatatagctgaacgcttcaccacgccctacaccataaccagcctgtaaagaataagcgcccataaagatgtaatcgccttttttcaccgggatccagttattgtcgaggttataaaccccctgaccggaaagaatataggcaccgtgttcctgaacgtgtgtttcgatataaccgtggctggcacctggtgcaaaagagaggatatgcatgttcatatcaaaacctaactctttgggcagaaaatccagcagaataacatcgtccatgccttcataatgaatgcgttccagttcgctggcattgccagaaaccagccacggtgcatagccttctaccggaacatagcggcgcttatataaaaagatttggctgtcttcggcctgggcgttaacaaacgtcattaaggagcctggcgggcaataaagatagccaccttcgcttaaggcaaatgttttgccttcggctttggcagtgatatttccagagatcacatacaggaacgtttcaatgccttcgccaccgaagccctgttggttgccaccgttttgatgcagtgtgaccagataatcaacaaaagaggcacccagctttggcgtggagaggattgtcgcgtcacaattttcaaagcccggaataatattttttaccagaccatccggggttaacagtgcgaaattaccgtgtttaacaatcgcacggttagccagtaaatcttcgcggtaaccggtgacgttatttaaatatcccatttatgactccttatttctgccaggcaagttgataaagcatgagtgccaacgttttgaccccttcggcaaggtcggtaatattggtgcgttccgccgggttatggctgatcccgttgatgctggggataaaaatcatgcaggttggtacgcgaggcgcgaaaatttgcgcgtcgtgcccggcaccactgtgcatcacccggtaattcagtttttctctttcacacaattctgtcagggtggcgaccagctccttattcatcggcacgggttcttcgtccatccataaatcgatatcaataccaatgtccatttcatcgcaaatcgcccgcatgtcgttttctaactgttgggtgaaatcgcgcagcacggcagcgtcggtatgacgacaatcaatggtgaacgtggttttacccggcaccacatttaccgtattcgggcgcggctctactttgccaaaggtcagaaccagcggatcgcccatccttttcgctttttcgaccgactgatggcaaatgcgactgaaagcgtaaactgtatcacgacgataacccatcggcgtggtgcctgcatggtttgattcgccgttcagcgttaccgtataacgacgctgcccgacaattgcattcaccacgccaattgattgcccattactttccagcacacagccctgttcaatatgcagttcaacaaaggctttaatatcctgacgcggagttagtggggcgttcggaagagtaaatccgcaagccttcatcgcatcgacaaaactatttcctttggcatcacagatattccgcacgtcgtcaggattcgccagcccaaaaatatttttactgccccagaagacatacgggaagcggctgccttcttcttctgccatcgccaccacttcgaccgtacgtagcggcgcgccgtattgcgttttcagccagtcaattgccagccacgccgccagcgcgccgaattgcccgtcaaggttaccgccgttaaccacggtatcgatatgcgaaccgctcagaaccacttcctgtggatattcggtgccattcaggcgaccgtataaattccccacttcatcgaaacgtgtttccagcccgcttgctgccattctttttttaaattgctgctgggtttccagccattccggcgaataaagtaaacgggtcatcccacccgctgggtcagcgccaaaagaggaaagccagggcagcgtttcttctatagcttgacggaaatgtgtaatcataagaaagtcctgtctcaataattattgcgcaaagggatttttcgtttcgtatgacgtgttataaagcgcgtcggaaattaaatactggtaaatatcatcaacaatttcgatgccttcgacggcggctttgcgttgtttaatatcctgatcctgtccgggataataaacctgattaaaaccgggcgcgggggtaatggcatttaattcgcgcatggtctggctaagatgttgacggaataattcgctggaggagaaaaagttcggattaataactatatgtaattgccccaaattacgccctgcgtgtaaatcgtcatacatcgaactaacctgtcgcccgaacggtaagccgagtaagacgcctgagaggacgtcaatcatcatcatcaggccatacccttttggcccggcggcggggagcagagcatgtaccgcgaacggatcggttgttggtacaccgtttttatcgaccgcccaggtatccgggatagacatattacgcgagcgggcgtcgagcacttttccccatgcctgtacggtagtcgccatatcaaaggtaaggatctcgtcgccttctcccggcgcggcaaaggccagggggttagtaccgtagtaaatttccgcgccgccaaacggcaccaccattggatcggactggcacatcgaaatgccaatgaatccggcgcgggctgcctgctgcacaaaataagagattgcgccgctgtgacccatccggctgataccgaccaccgcaacgccattttgctgggcggttttgatggcatgttccatacccattttcgccgcgacctgtccggcggcattgtcggcatgtaaaattgccgagcacggcccggtttcctcaagacgaaactccggttcgcggttggtgccgccttttgaaatgcgttccgcgtagtattccacgcgcaccgcgccatgagagtggatccctctggcatcggcgtaaaccaatacttcagccacggttgcagcgtgctcacgttttaacccagcctggcagagtttattctcaattagctggtggagtgtttcccgactgattttcatctgtcttcctttttaacgacggtgtgaagcatgactgcaattaacatacagggaaaatatctggattatgtgatccagacaggcaaaaaaatatagttagaatttatttgataatccgctcacttttaacctgatttttaaaacaacaacgcttattaaaaaataatgagtaatagcctggtggttatttgaattcttttgttaataattcctgtgtgatattcatcaccttatttactcgttgtcatcgataccgtaatcgccacattaacactgctcgtgcaattgccatgggtgcaatttttaaggagttgttatgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagataccacaggtttctggcatgacgattttaataacgccacgccgaacgatatttgcgtggcaattcgtagcgaagcggcggatgcggggatcgcgcaggcgattatgcagcagcttgaagaggcgctaaaacaactggcgcaggggtcaggcagcagccaggcgttgacgcaggtgcgtcgctgggacagtgcctgtcagaaattacccgatgccaatctggcgctgatttcagtggctggcgagtatgcggcggagctggcaaaccaggcgctggatcgcaacctcaacgtgatgatgttctccgataacgtcacgctggaagatgaaatccaacttaaaacccgcgcgcgggaaaaaggcttgctggtgatggggccggactgcggtacgtcgatgattgccggcacaccgctggcttttgctaacgtgatgccggaaggcaatattggcgtcattggcgcttccggtaccgggattcaggagctgtgttcgcagattgcgctggcaggggagggaattactcacgcgattggccttggcgggcgcgacctcagccgtgaagtgggcggcatcagtgcgctaacagcgctggaaatgctcagtgcagacgagaaaagcgaagtgctggcatttgtttcaaaaccacctgccgaagctgtgcgtctgaaaattgttaatgccatgaaagcaaccggcaaaccgacggtggcgctgtttttaggttataccccggcggtggcccgcgacgagaatgtctggtttgcctcctcgctggatgaggccgcacgcctggcttgcctgctttcacgcgtcacggcgcgacgtaacgcaatagcgcctgtcagcagcggatttatttgcggtttgtataccggcggtacgctggctgccgaagcggcgggattacttgccggacaccttggcgtggaagccgacgatacccatcaacatggcatgatgctggacgccgatagccaccagattattgacctcggcgatgatttctacaccgtcgggcgtccccatccgatgatcgacccaaccttacgcaaccagttaattgccgatctcggcgctaaaccgcaagtgcgcgtgttgctgcttgatgtcgtgattggcttcggtgcgaccgccgatcctgccgcctcgctggtgagcgcctggcaaaaagcctgtgccgcgcgtttagataatcaaccactgtatgccattgccacggtgacaggcactgaacgtgacccgcaatgccgctcgcagcaaatcgccacgctggaagatgcggggattgcggtcgtgagttcgctaccggaagccaccttgctggcggcagcgttaattcatccgctctcgcctgccgcacagcaacacacaccgtcattactggaaaacgtcgccgtgattaacatcggattacgcagctttgcgctggagctacaaagcgccagcaaaccggttgtgcattaccaatggtcgccagtcgccggtggcaataaaaaactggctcgtttattagaacgtttgcaataaggggttcccatgtttacatcagtggcgcaagccaatgctgcggttatcgaacaaattcgtcgcgctcgtccacactggctggatgtgcaaccggcttcttcacttatcagcgaactaaacgaaggcaaaacactgcttcacgccgggccgccaatgcgctggcaggagatgaccggacccatgaaaggggcgtgcgtgggcgcatgtctgttcgaaggttgggcgaaagatgaagcgcaggcgctggcaatactggagcaggggaagtgaacttcattccttgtcaccatgtgaatgccgtcgggccaatgggcggtattacttctgccagtatgccgatgctggtggttgagaacgtgaccgacggcaaccgggcgtactgcaacctcaacgaaggtatcggcaaagtgatgcgttttggcgcttacggcgaagatgtcctgactcgccatcgctggatgcgcgatgtgttaatgccagtattaagcgcggcgctggggcgcatggagcgcggtatcgatctcacggcgatgatggcgcagggcattacgatgggcgatgagttccatcaacgcaatattgcttcctctgcactgttaatgcgtgcgctggccccacaaattgctcgcctcgatcatgataaacagcacatcgccgaagtgatggatttcctcagcgtgaccgatcagttcttcctcaacctcgcgatggcttactgcaaggcggcgatggatgctggcgcgatgatccgcgcaggcagcatcgtcacggcaatgacccgcaacggcaatatgttcgggattcgggtaagcgggctgggcgaacgctggtttactgcgcctgtaaacactccgcaaggtctgtttttcaccggcttctcgcaggagcaggcgaacccggatatgggcgatagcgcgattaccgaaacctttggtatcggaggtgcggcaatgatcgcagcgcctggcgtaacgcgctttgtcggtgcgggtggcatggaagcggcaagagcggtatctgaagagatggcggaaatttaccttgaacgcaatatgcagttgcagatcccaagctgggattttcagggcgcgtgcctggggctggacattcgtcgcgtggtagaaaccggcattacgccactcatcaataccggtatcgcccataaagaggcggggatcgggcagattggcgcaggcaccgtgcgggcaccgctggcgtgctttgaacaggcgctggaagcactggctgaaagcatgggtattggttgaggaacgcgcaatgacgatcatccatcctctgcttgccagtagtagcgcaccgaattatcgccagtcctggcggttagcgggagtgtggcggcgggcgattaacctgatgacggaaagcggcgaactgttaacgttgcatcgtcagggtagtggtttcggccccggaggatgggtgcttcgccgtgcgcaattcgatgcgttatgcggtggattatgcggcaatgaacgaccacaggttgtggctcaagggattcgcctcgggcgtttcacggttaaacagccacagcgttattgtttgctgcgtattacgccgcctgcgcatcctcaaccacttgcagctgcatggatgcaacgcgcggaggaaaccgggcttttcgggccactggcgttggcggcaagcgatccgctgcctgctgagttacgccagtttcgtcactgttttcaggccgcgctcaatggcgttaagaccgactggcggcactggctgggtaaaggccccggattaacgccgagtcatgatgacacgctgagcggaatgctgctggcggcctggtattatggcgctttagatgcgcgctccggtcgtccgttttttgcctgttccgacaatctgcaactcgttaccacagcggtgagcgtcagttatttacgttatgccgcgcaaggatatttcgcctcgccactcctgcactttgttcatgctctgagttgcccgaaacgtaccgctgttgcgattgattcgctgctggcgctggggcatacgtcaggggcagatacgctgctggggttctggcttggccaacaattattacaaggaaaaccatgaaaacactggttgtggctcttgggggcaacgccttactccagcgcggtgaggcgctgacggcagaaaatcaatatcgcaatatcgccagtgctgtacccgcgctggcacgcctggcccgttcttatcggttggcgattgttcacggcaacgggccgcaggtggggctgctggcattgcagaatctggcgtggaaagaggtagaaccgtatccgctggatgtgctggttgcggaaagccaggggatgattggctatatgctggcgcagagtttgagcgcacagccgcagatgccgcccgtgacgacggtgctgacgcgcattgaggtttcgcctgatgatccggcgtttttgcagccagagaaatttattggtccggtttatcagccagaagaacaagaggcactggaagcggcttacggctggcagatgaaacgtgatggtaaatatttgcgccgggtggtggcgtctccgcaaccgcgtaaaattctcgacagcgaagccatcgagttgttgctcaaagaggggcatgtggtgatttgcagtggcggcggcggtgtgcctgtgacggatgacggagcagggagtgaagcagtgattgataaagatctcgccgctgcgttgctcgccgagcagattaatgcagatggactggtgatcctcaccgatgctgatgcggtatatgaaaactggggaacgccgcagcaacgtgccattcgccatgccacaccggatgagttagcgccatttgccaaagccgatggttcgatggggccgaatgtaacggcggtgagtggttatgtcagaagccgtggtaaacccgcgtggattggggcgttatcgcgaattgaagagacgctggcgggcgaagcggggacctgtatttcgctgtagtcgtaggcattagacatttgtgcctgatgcgacgcttgacgcgtcttatcaggcctacaaccggtgccgcatccggcaattggtgcacaatgcctgatgcgatgcttgacgcatcttatcaggcctacaatgggtaccggatcggtaggccggataaggcgtttacgccgcatccggcaagaatagagcaccagttaaccgaacttactctgcgcccaaatcacgccgctggcatattccggcggcagcagcgggattaaggcttccagcgtcgcagtcagacgcgatgtgtcgctgtcggtcaaattcagatgccccactttacgccccggacggacttctttgtcgtaccagtgcagatgcaccagcggcagtttcagccagtcataattcacatcgctaccaatcagattgatcatcaccgacggattattcaccactggttgcggtaacggcagatcggtaatcgcccgcagatgcagctcaaactggctgatgctggcaccgttttgtgtccagtgaccgctgttatgcacacgcggtgccagttcgttgatcaacagaccttgcggggtgacaaaacactccatcgccatcacgcccacatagcccagctcctgcataatcgccgacagcatctcttcggcttgcgcctgctgctgtgcgttggcctgcggaaaagcgacgctggtgcgcaaaataccgtcctgatgcaggttatgcgtcagcggataaaacacggtgctgccatcaaagccgcgcgcgccaaccagcgacacttcaccagagaagttaatgccctgctcgacaatacattcgccgtaacactctgccggtaactgttcggtttcatttgcgcgtaaacgccattgaccgcgaccgtcataaccaccagtgcgacgcttaacaatcgccagctcacctaaacgatcaaacaccgcaggccactcgctgcgttcggcaagtaactgccacggtgcagtcggcaggtggagcttatcgaaaagctgcttctgagtcagacggtcagcaataatcgggaacacatcgcggttcacaaaggccggatggcgcgccagctcgcgggttaatgcggtttccggccagcgttctatctcagcggtaatcacgctttgttgaaaaggcaccgccgccggttcagcgtccagcccgactggccagacagcaatgcctaacggttcgcctgcctgacgcagcatacggcctaactgcccgttaccgaggacgcaaacctgtttcatgccgcacctcgcgggtccgggttttccagcacttcgtcggtctgggctttgcgccagtcattcagacgctggtgcagttctttatcatgagtcgcaagaatttgtgctgccagtaacgccgcgtttgccgcgccagctttaccaatcgccagcgtacccaccggaatgccgcgcggcatttgtacgatggagtagaggctatcgacaccgctcagtgcggcgctctgtactggcacgcccagcaccggcaccagcgttttggcggcaatcatgcctggcagatgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagagcaaggaaaacggttgcgtggctgtgaaatcagcaaagttgcgggttttttaaaacggaaaatgaatcagctcaacgtcatccgccgtgactttcaccattgaaccttccgtatgccaggcacccagtaccacgcgaaaagcaggttgctgattggcgataagttcatgcaccgccgggcgatgggtatgcccgtggatcagccattgcacctgatgtttttccatcgcactgaccaccgcgttttggttaacgtccatgatcgccagcgatttactgctgttggcttctttgctgttcgcgcgcattcgcgcggcaatgcgtttgcgcacaaacaacggcagggcgaggaatagcgtctgcagccagggtttgtggaccttggcgcgaaaagcctgataacccgcgtcatcggtgcacagcgtgtcgccatgcataatcaacacccggcgaccataaagttcgagcaccttttcttccggcaataacgtcatgccactttcacgggcaaagcgtttgccgagcagaaaatcacggttgccatgaatgaaataacagggaacgccggaatcggacaccgctttgatcgccgccgccatcttgcgatggagtgggttgggatcgtcgtcgccaatccatgcttcaaacagatcgccaagaatatacagcgcgtcggccttgcgggcttcccccgctaaaaaacgcagaaaaccggcggtgatcgccggttcttccacgcagagatgaagatctgcaataaagagtgtcgccacgattactcgctaacggtcacgctttcaatgataacgtcttcttttggcacgtcctggtgcataccgctacgaccggttgcaacacctttgattttgtctaccacgtccatgccgtcaaccacttcagcaaacacgcagtagccccaaccttgcaggctttcgccagagaagttcaggaagtcgttatcaaccacgttgatgaagaactgtgcagttgcagagtgcggagcctgagtacgtgccattgccagcgtaccacgggtatttttcaggccgttgttggcttcgtttttgatcggttctttggtggctttttgtttcatgcccggttcaaaaccgccgccctgaatcataaagccgttgataacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccagttcgggtcatatatagggtggtgttatagcataaccgcacgatcggatcatcacgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcttttgacgtggttgcgcgctatctgcgtttcctcggctataaactgaagtatgtgcgcaacattaccgatatcgacgacaaaatcatcaaacgcgccaatgaaaatggcgaaagctttgtggcgatggtggatcgcatgatcgccgaaatgcacaaagattttgatgctttgaacattctgcgcccggatatggagccgcgcgcgacgcaccatatcgcagaaattattgaactcactgaacaactgatcgccaaaggtcacgcttatgtggcggacaacggcgacgtgatgttcgacgtcccgaccgatccaacttatggcgtgctgtcgcgtcaggatctcgaccagctgcaggcaggcgcgcgcgttgacgtggtcgacgacaaacgcaacccaatggacttcgttctgtggaagatgtcgaaagagggcgaaccgagctggccgtctccgtggggcgcgggtcgtcctggctggcacattgaatgttcggcaatgaactgcaagcagctgggtaaccactttgatatccacggcggcggttcagacctgatgttcccgcaccacgaaaacgaaatcgcgcagtccacctgtgcccatgatggtcagtatgtgaactactggatgcactcggggatggtgatggttgaccgcgagaagatgtccaaatcgctgggtaacttctttaccgtgcgcgatgtgctgaaatactacgacgcggaaaccgtgcgttacttcctgatgtcgggccactatcgcagccagttgaactacagcgaagagaacctgaagcaggcgcgtgcggcgctggagcgtctctacactgcgctgcgcggcacagataaaaccgttgcgcctgccggtggcgaagcgtttgaagcgcgctttattgaagcgatggacgacgatttcaacaccccggaagcctattccgtactgtttgatatggcgcgtgaagtaaaccgtctgaaagcagaagatatggcagcggcgaatgcaatggcatctcacctgcgtaaactttccgctgtattgggcctgctggagcaagaaccggaagcgttcctgcaaagcggcgcgcaggcagacgacagcgaagtggctgagattgaagcgttaattcaacagcgtctggatgcccgtaaagcgaaagactgggcggcggcggatgcggcgcgtgatcgtcttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggcgtggtgtaacgagacaatgcaaacggcgcgacttttatcacctgccagggagcgaaaaagcgttcatctgaccacggccacagccagccaacgcctttaccgccagtggttaccgaatccagcaagctgtgcgatagcaacgagacggttaaaaacagccagcagcgaatcagcccagccctgaaccatcggcgtccaataaacacacataacagcgggacaacaaacgcaaacaccagcgaatgggtaaacccgcgatgaccaaaaacattgccgtaagcaacgccaaatttaaacgacaatacgtcggcgtcgggcagcatcgccaggatgattccggcaaataacagacgcggagggatgactttcgaacccaaccctaaaccaatgcataggggaacggcggcgtgcgtaataacggttggcatgatggtcgcttcggcaaaatgtcgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacgattttgcagcgtttgcgcgtttcaaccgcaccgtcgactttcacctggccttcggcaatcgcgattttcgcctgcgcgccgctttcgctccagccttccagtttcagcaagtcgcacagctcaacgtgcggatgtttacctaaagaaaatgtcgccatgttactcatcctgtggatcatgatattcaacgcacgcctgtagcgtgttttcaatcagcgtggcaaccgtcatcgggccaacgccgccgggaacaggcgtaatgtatgaggcgcgtttagccgcgtcttcaaacacgacgtcgcccacaactttgccattttccagacggttgatgccgacatcaatcacaattgcgccttctttgatccagtcaccgggaataaagcctggcttgccaacggcaacgatcaatagatcggcattttctacgtgatgacgcagatttttagtgaagcggtgagtcactgtagtggtgcaacctgccagcagcagttccatgctcatcgggcggccaacgatattcgatgcgccaatcaccacggcgttgaggccgaaggtatcaatgttgtaacgctcaagcagcgtgacgataccgcgcggggtgcagggacgcagacgcggcgcgcgctggcacagacgaccgacgttgtaaggatggaaaccgtccacgtctttgtccggatgaatacgttccagcactttgacgttatcaatacccgccggtaacggcagttgaaccagaatgccatcgatggtgttgtcggcattcagcgtatcgataagctccagcagctccgcttcgctggtggtttccgggaggtcataagagcgggagacgaacccgacttcttcacaagccttgcgtttgcttgcgacataaatttgcgatgcagggttactacccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtagatcgaaggggatgcgcctattttgtcagaagcggggcgcgctgtcaggtttcgtttcagatttatcgcgtgaagcgacctcttgcgaaggtgaggcgcaccgtcgctgagactgaaagcttcatttttcgtccatgatggcgttgtaaatctggaactgatttatttccttgtctaaggattaagataatttaagaaatacctgacaatataaaaagaattttcagcctggtaatttaccgcttcaggtctatatttgtgttgaatatattttgcgcggaagtattcatctaacggggctctctattttttagaatagagtgcatattttcaattaagacattcttagaggataaaaaggaatttactactatcagtgtcttaaataaagtaatcggttatatacggatgtggagtcgataaatgagattgaaggaatatatatgaaattaagatttatttcgtctgcgctggctgccgcactattcgccgctacgggtagttatgctgccgttgtagatggcggtacaattcactttgaaggcgaactggtgaatgctgcctgttcagtgaatactgactcggcagaccaggttgtcacactcggtcaatatcgtaccgatattttcaatgctgttggtaatacctctgcattaattccattcaccattcagttgaacgactgcgatcctgttgttgccgctaatgctgccgttgcattttctggtcaggctgatgcaatcaatgataatttattggccattgcatccagtaccaatacaacaacagcaacgggtgtcggtattgaaatacttgataatacatccgcaattctcaaacctgatgggaatagcttctcaaccaaccagaacttgatccccgggaccaacgttcttcatttttctgcacgttataaaggcaccggtacaagtgcatcagcagggcaagcaaatgctgacgcgacttttattatgagatatgaataatcaaaaccacgttgttttgaattatatatcacgtcttataacaaagtaatgtaccggttgtctgaagcggtatggtggcaatgtaaatcgaaatcatgttcactttgtatcatgccgctttattaaatgaaaagggaatgatgtgttgtaagaaaccaaagcaatcatttctttatattccttatttttgccgtcaggaatacacaaggcgtattaactatgatgactaaaataaagttattgatgctcattatattttatttaatcatttcggccagcgcccatgctgccggagggatcgcattaggtgccacgcgtattatttatcccgctgatgctaaacagactgcggtatggattagaaatagccataccaatgagcgctttctggtcaattcgtggattgaaaacagcagcggtgtaaaagaaaagtcattcatcattacaccgccactgtttgttagtgaacccaaaagcgaaaatactttgcgtattatttacaccggtccaccgctggcagcagatcgtgagtctctgttctggatgaatgttaagacgatcccttcggtagataaaaatgcattgaacggcaggaatgttttgcaactggcgattttatcgcgcatgaaattatttctccgtccaattcaattacaagaattacccgcagaagcgccggacacactcaagttttcgcgatccggtaactatatcaatgttcataatccatcacctttttatgtcaccctggttaacttacaagtgggcagccaaaagttggggaatgctatggctgcacccagagttaattcacaaattcccttaccctcaggagtgcagggaaagctgaaatttcagaccgttaatgattatggttcagtaactccggtcagagaagtgaacttaaactaaccgaatcatctgacaatatcagagctaattatgaaaatacccactactacggatattccgcagaggtatacctggtgtctggccggaatttgttattcatctcttgccattttaccctcctttttaagctatgcggaaagttatttcaacccggcatttttattagagaatggcacatccgttgctgatttatcgcgctttgagagaggtaatcatcaacctgcgggcgtgtatcgggtggatctctggcgtaatgatgagttcattggttcgcaggatatcgtatttgaatcgacaacagaaaatacaggtgataaatcaggtgggttaatgccctgttttaaccaggtacttcttgaacgaattggccttaatagcagtgcatttcccgagttagcccagcagcaaaacaataaatgcatcaatttactgaaagctgtacctgatgccacaattaactttgattttgcagcgatgcgcctgaacatcactattcctcagatagcgttgttgagtagcgctcacggttacattccgcctgaagagtgggatgaaggtattcctgctttactcctgaattataatttcaccggtaacagaggtaatggtaacgatagctatttttttagtgagctcagcgggattaatattggcccgtggcgtttacgcaacaatggttcctggaactattttcgcggaaatggatatcattcagaacagtggaataatattggcacctgggtacagcgcgccattattccgctgaaaagtgaactggtaatgggagacggcaatacaggaagtgatattttcgatggcgttggatttcgtggtgtacggctttattcttctgataatatgtatcctgatagccagcaagggtttgccccaacggtacgtgggattgcccgtacggcggcccagctaacgattcggcaaaatggttttattatctatcaaagctatgtttcccccggcgcttttgaaattacagatttgcacccgacatcttcaaatggcgatctggacgtcaccatcgacgagcgcgatggcaatcagcagaattacacaattccgtattcaacagtgccaattttacaacgcgaagggcgtttcaaatttgacctgacggcgggcgattttcgtagcggtaatagtcagcaatcatcgcctttcttttttcagggtacggcactcggcggtttaccacaggaatttactgcctacggcgggacgcaattatctgccaattacaccgcctttttattagggctggggcgcaatctcgggaactggggcgcagtgtcgctggatgtaacgcatgcgcgcagtcagttagccgacgccagtcgtcatgagggggattctattcgcttcctctatgcgaaatcgatgaacaccttcggcaccaattttcagttaatgggttaccgctattcgacacaaggtttttatacccttgatgatgttgcgtatcgtcgaatggaggggtacgaatatgattacgacggtgagcatcgcgatgaaccgataatcgtgaattaccacaatttacgctttagccgtaaagaccgtttgcagttaaatgtttcacaatcacttaatgactttggctcgctttatatttctggtacccatcaaaaatactggaatacttcggattcagatacgtggtatcaggtggggtataccagcagctgggttggcatcagttattcgctctcattttcgtggaatgaatctgtagggatccccgataacgaacgtattgtcggacttaatgtttcagtgcctttcaatgttttgaccaaacgtcgctacacccgggaaaatgcgctcgaccgcgcttatgcctcctttaacgccaaccgtaacagcaacgggcaaaatagctggctggcaggtgtaggtgggaccttactggaaggccacaacctgagttatcacgtaagccagggtgatacctcgaataatgggtacacgggcagcgccacggcaaactggcaggccgcttacggtacgctggggggcgggtataactacgaccgcgatcaacatgacgttaactggcagctgtctggcggtgtggtcgggcatgaaaatggcataacgctgagccagcctttaggggataccaatgttttgattaaagcgcctggcgcaggcggtgtacgcattgaaaatcaaactggcattttaaccgactggcgcggctatgcggtgatgctgtatgccacggtttatcggtataaccgtatcgcgcttgataccaatacgatggggaattccatcgatgttgaaaaaaatattagcagcgttgtgccgacgcaaggcgcgttggttcgtgccaattttgatacccgcataggcgtgcgggcgctcattaccgttacccagggcggaaaaccggtgccgtttggatcactggtacgggaaaacagtaccggaataaccagtatggtgggtgatgacgggcaagtttatttaagtggtgcgccattgtctggtgaattactggttcagtggggagacggcgcgaactcacgctgcattgcgcactatgtattgccgaagcaaagcttacagcaagccgtcactgttatttcggcagtttgcacacatcctggctcataaaggaaattatcaataagataatctgcagattattattggcgatggcatgtttgtgtctggcaaacatatcctgggctactgtttgtgcaaatagtactggcgtagcagaagatgaacactatgatctctcaaatatctttaatagcaccaataaccagccagggcagattgttgttttaccggaaaaatccggctgggtaggtgtctcagcaatttgtccacccggtacgctggtgaattatacataccgtagttatgtcaccaactttattgttcaggaaactatcgataattataaatatatgcaattacatgattatctattaggtgcgatgagtctggttgatagtgtgatggatattcagttccccccgcaaaattatattcggatgggaacagatcctaacgtttcgcaaaaccttccattcggggtgatggattctcgtttaatatttcgtttaaaggttattcgtccctttattaacatggtggagatccccagacaggtgatgtttaccgtgtatgtgacatcaacgccttacgatccgttggttacacctgtttataccattagttttggtggccgggttgaagtaccgcaaaactgcgaattaaatgccgggcagattgttgaatttgattttggtgatatcggcgcatcgttatttagtgcggcagggccgggtaatcgacctgctggtgtcatgccgcaaaccaagagcattgcggtcaaatgtacgaatgttgctgcgcaggcttatttaacaatgcgtctggaagccagtgccgtttctggtcaggcgatggtgtcggacaatcaggatttaggttttattgtcgccgatcagaacgatacgccgatcacgcctaacgatctcaatagcgttattcctttccgtctggatgcagctgcggcagccaatgtcacacttcgcgcctggcctatcagtattaccggtcaaaaaccgaccgaagggccgtttagcgcgctggggtatttacgcgtcgattatcaatgaggtacggagaatgagaagagtactctttagctgtttctgcgggctactgtggagttccagtggatgggcagttgaccctttaggaacgattaatatcaatttgcacggtaacgttgttgatttctcctgtaccgtaaacacagcggatattgataagacggtagatttaggcagatggcctacgacacaactactgaacgctggcgataccacggcactcgtcccttttagcctgcggctggagggatgtcctccgggttcagttgcgattttatttacgggaacgccggcatccgataccaacctgctggctctggatgatcccgcaatggcacaaaccgtcgccatcgaattacgtaatagcgatcgctcccggctcgcactgggggaggcgagcccgactgaggaagtagatgcaaatggcaatgtcacactaaacttttttgccaattatcgagcgttagccagcggtgttcggccaggtgtggcgaaagcggatgcgatatttatgatcaattataattaatattatattaattcgtataatttggcgtagtcgataagctctacaattgaatgcaaacctagcttgccataaatattagatttatgcgcactaactgttttattgctaagtaataacttatcggcaatttctttattagataatccgctaaccagataacgtaatatggtcacttcacgattagatagcacagtgaccgttgaactattcgtactacatttattgctttttatatagttaagcgtttcgctgggaaaaaacgtgtatccggagaggatcatctgaacggcatgaaaaatatcattctgatcattgcatttactgacaaaaccgttagcaccagcttgtatcgctctgccagcataaaagcattctgatttcgatgataaaaataacactttcactgtgctctggatttgtttgatccttttcaggaaggtaaaaccgtctgttccgggcaagtctatatccataatgattaaatcaacaggacgggttcggagataatcgatggttatgcgataatcatccgttttcaggacaatctgcaattcactgtttttttgcaacagaacttcaatagacattctgatgataggatgagtatccataatgatcaccgacgttggtttcatagttaccagtctcataggagcggacaattttccgttaggtcgggaaattgtactttgatacatgaaaatacgggttttcttgattcagacgcgcagcggtgtgcgtttgtttgccgctatagcgaaataaatcagaaaatcagacgcggtcgttcacttgttcagcaaccagatcaaaagccattgactcagcaagggttgaccgtataattcacgcgattacaccgcattgcggtatcaacgcgcccttagctcagttggatagagcaacgaccttctaagtcgtgggccgcaggttcgaatcctgcagggcgcgccattacaattcaatcagttacgccttctttatatcctccataatttcagagtgggacatatttgggacattatcaccaaaaatgtcgtctattttcctcgcatgctctgtcaaatgattaggcgcaaggtgagcatacctacgaaccatttctatggactcccatccgcccatttcctgaagcactgataatgggacgcctgactgaatcagccagcttgcccaggtgtgtctgaggtcatggaaacggaaatcttcaattcctgcacgacgacaagctgatagccatgatgtcttgctgtcgatgcgcatcttcctgaccgcaggcgttgatgttccatctgctcgcttagccgccttggtatgtacaaacacccatttgtgatgcttgcctatttgatcacgcaacactttacaggcggtatcgttcagcgccacaccaatggcgcggtttgatttgctctcttctggattcacccaggcaactcgtcgctgcatgtcgatttgttgccattccagatttatgatgttcgactttctcagaccagttgccagcgcaaacttgacgacagatttcagtggttcggggcactcatcaataaggcgttttgcttcctccttttccagccatctgactcgcttgtttctgaccgctggtatcttgatgacaggcgctttttccagccacttccagtcgcgttctgcagcacggagaatggcctttatcatggcaagatgctttgcctttgtctgagttgatactggctttggttcataaacaggcagttctttacctttcctgatggcggcctgaactttctgtttccatatttctttcgtctttctgttatgcattctgcttacagcagagtaaatctttgcctccgagatatctttaagccttataccctcaaaatgttcaagccagaactcaatccggcttttatctgaatcgagagattttttatcagctttttcctcaagccatcttaggcaggcctcttcaaaagtgacatcaggtaaatcccctagcttttctactcgccagagttctgcttttcgcttgtcgtgcaactcctgagcttgccgtttgtcctttgtgccaagagattccttaattcgtttcccgcccgggagcgaatacgaggcataccatatttcatttctgcggaagagtgacattttctttcctctgttatgccatcacccgcgctcacctggacagtatgcagcggagactgaagcgccgcaatgcaggcttgccgtgttgtgaggtacccggatattatcgtgaggatgcgtcatcgccattgctccccaaatacaaaaccaatttcagccagtgcctcgtccattttttcgatgaactccggcaccatctcgtcaaaactcgccatgtacttttcattccgctcaatcacgacataatgcaggccttcacgcttcatgcgcgggtcatagttggcaaagtaccaggcatcttttcgcgtcacccacatgctgtactgcacctgggccatgtaagccgattttattgcctcgaaaccaccgagccggaatttcatgaaatcccgggaggtacgagtattgccggaagcgtggcctgtatccggatgcagagtcttatccgtggaaatcgaacgcgcattactggttggttaccaacttgtaccagaacatgcgggccaatgcgctggctgacgcggaattacggcgcaaggctgccgatgaactgacctgtatgacagcgcgaattaaccgtggtgagacgatacctgaaccagtaaaacaacttcctgttatgggcggtagacctctaaatcgtgcacaggctctggcgaagatcgcagaaattaaagctaagttcggactgaaaggagcaagtgtatgacgggcaaagaggcaattattcattacctggggacgcataagagcttctgtgcacaggacgttgccgcggtaacaggcgcaaccgtaatctgatcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcaaccagcataaatcaggctgcggctaaaatggcgcgggcaggaatcctggtcgttgatggtaaggtctggcgaacggtgtattaccggttcgctaccagagaagaatgggaaggaaaggtgagcacgaatctgatttttaaggagtgtcgccagagtgccgcgatgaaacgggtattgagggtatataaaagaacatcaatgggaacacaatgatgaaacaggtgagttgagttcaaactgtagtacaattctctccagtttgaacaggaaagaatatgctatgaacccttatatttatcttggtggtgcaatacttgcagaggtcattggtacaaccttaatgaagttttcagaaggttttacacggttatggccatctgttggtacaattatttgttattgtgcatcattctggttattagctcagacgctggcttatattcctacagggattgcttatgctatctggtcaggagtcggtattgtcctgattagcttactgtcatggggatttttcggccaacggctggacctgccagccattataggcatgatgttgatttgtgccggtgtgttgattattaatttattgtcacgaagcacaccacattaaaataatttgtttctaaacgactaaaatatggaggctcttatatttatatgagcctcgttttatgctttttgttaatgtctttattttttatgtattcttttgtgctttcaagattatggcgtaagaaaattgcaatacgattattgttgtatattcaagataatgtgaccttaattgtctttttaaataaaaaataaacaaaaattatatcccaccactaaggtttataaaagcatacgttagcaggtgtcaccatgaaaaaagccatagcatatatgcgattttcatcaccaggtcagatgtctggcgactcattaaaccgacagagaagacttattgctgaatggttaaaggtaaatagtgattattatcttgataccataacatatgaagatttaggattaagtgcattcaaaggaaagcatgcacaatcaggagctttttcggaatttttagatgctatagagcatggttatatattgccaggaactacattgttagttgaaagtctggacagactttcaagagaaaaagtcggtgaagcgattgaacgtctgaaattgattttgaatcacggtattgatgttataactctttgcgacaatacagtctataatattgactctttgaatgagccatattcattaataaaagccatacttatagcacaaagggcaaatgaagaaagcgagataaagtcaagtcgggttaaattatcatggaagaaaaaacggcaggatgcactggaatcaggtacgattatgacggcgtcttgtccgagatggctctccttagatgacaaaagaacggcttttgttccagaccccgacagggtgaaaactattgagctaatttttaaactcaggatggaaaggcgctcattgaatgcaatagccaagtatttaaatgatcatgctgtaaagaatttctcaggaaaagaaagtgcatggggaccttctgtaattgaaaaattattagcgaataaagctctgataggtatttgcgtaccttcatatcgtgcaagagggaaagggataagtgaaatcgctggctattatcccagagtcatatcagatgatttgttttacgctgtacaggaaattcggttggcaccttttggtattagcaatagtagcaagaatcctatgctaataaatctacttcgaacagttatgaagtgtgaggcttgtggtaataccatgattgttcatgcggtatctggaagtttgcatggctattatgtttgtccgatgagaagattacatcgatgtgacaggccatcaataaaaagagatttggttgattataatatcattaatgaattgctttttaattgtagcaaaattcaaccagttgaaaacaagaaagatgctaatgaaactttagagttaaaaattattgagcttcagatgaaaattaataatttaatcgttgcattgtctgtcgcgcctgaagttaccgctatagcagagaaaataagactattagataaggaattacgaagggcttcggtatcattgaaaactttgaagagtaaaggtgtaaattcattcagtgatttttatgctattgacttaaccagtaaaaatggacgagagttatgccgtacacttgcctataaaacattcgaaaaaatcataattaatacggataataaaacctgtgatatctattttatgaatggcattgtttttaaacactatcctttaatgaaagtaatatccgcccagcaggcgataagtgctctcaaatatatggttgatggtgagatttatttctaaataatgatctcggattttaagttatgctatggtgataaagtgcaagacagaattaattatctttgacgaaacttaatgggtaattactttgtttgctcccacaagcgagttttgtacggctgtattggggtagtaaatgagctatacaatcttaatcatttgttaggtgagaactcttggtcgcagattcaaatactgaaaatacgtgacaaattattatgagcaaaatggtgtatgtcacgtattttgaatggtaggttaaaaaataacaccgactttcgtaggtgttactaataataaagcagagtttttagatagtatcaatgtgctttgtgtatattgtggcaaataattgggttgggggtacaattgtgattgcttttgcatgaacattgcgcctttatgcataatgagataaaggaatatcaaataaaataacgataggtcataacaaagaggtttttatgaaaacacttatcgtttcaactgtattggcattcataacattttctgcgcaggctgcagcatttcaggtcactagtaatgaaataaaaacaggagagcaacttacaacgtctcatgtcttttctggatttgggtgtgaaggtggtaatacatcgccctcattaacctggtctggtgttcctgaaggtaccaaaagctttgccgtaactgtatatgatccagatgcacctacaggcagtggttggtggcattggactgttgttaatattccagcaacagtaacatatttgcccgttgatgcagggagacgtgatggaacaaaactgccgactggtgctgttcaaggccgaaatgattttggctatgctgggtttggtggcgcatgtcctcctaaaggagataaaccacatcattaccagtttaaagtatgggctctaaaaactgaaaagattcctgtagattctaactccagcggagcgttagttggttatatgcttaatgctaataaaatcgcaaccgctgagataacaccagtttatgagataaagtagggtgagagtatgctggcaagaggtaagactaacttaaagatcgaagaaatacggatgcataaacatcatgagattcatagggttaagcctcttatgccagctttgtgtcgtatccgtcagggaaagaaagttatcaattgggagacgcatactttaactgttgataataatcaaataatattatttccttgtggttatgaattttatattgagaattatcctgaagcagggctttatcttgcagaaatgctttacttacccattgatttaattgagagtttccaaaaactttatacggtaactgatcaaatacgtaacaaaacaagtttctttttacctcagaatcctgagttaatatattgttgggagcaactaaaaacatctgtttcccgaggcttctcaactaaaattcaggagcacttagcaatgggcgttctactttcgttaggagtgaatcatgttaatcatttacttttatcatatagtaaacaatcattgataagtcgttgttataacctgctgctatccgaacccggcacaaaatggacagcaaacaaggttgctcgatatctctacatttctgtttctacattacatcgccgtctagcaagcgagggggtaagtttccaaagtatactggacgatgtgaggttaaataatgcgttgtctgctatacaaacgacggtaaaacctataagcgagattgccagagaaaatggttataagtgtccttctcgttttactgaaagatttcataatcgttttaatataacaccaagagagataagaaaagcttccagagagtaaaagtgttttaagaaggagcaattctatcgattttgattttgggaaatcaacacggcataattatgtcaccggagcctgaacaactccggtgacttctgcgctaaacggggacgtttatgcgcacatacaatccaaactctcttctcccttcacagatgcagaaatgcacctgcaattctttgcatctagcgtttgacctctgcggaggggaagcgtgaacctctcacaagacggcatcaaattacatcgcggcaacttcaccgctatcggtcggcagatccagccttatctggaggagggcaaatgctttcgcatggtgcttaaaccgtggcgtgagaaacgcagtctttcccagaatgcactcagccacatgtggtacagcgaaatcagtgaatacctcatcagcaggggtaaaacgttcgccactccagcttgggtaaaagatgctctcaaacacacatatctcggttatgaaaccaaagacctggttgatgtcgtaaccggtgatatcaccactatccagtcgttacgccatacctccgatcttgataccggagagatgtatgtcttcctgtgtaaggttgaagcctgggcgatgaatattggttgccacctgactattccacagagctgcgagttccagctgctgcgcgacaagcaggaggcgtaatggctacaccgcttattcgtgtcatgaacggacacatctacagagtaccaaatcgtcgtaagcgtaaacctgagctgaagccatccgaaataccaacactgctcggatataccgccagcttggttgataaaaaatggttgcgactggcagcaaggaggagtcatggctgatttgagaaaagcagcgcgtggtcgggaatgccaggtaagaatccctggcgtatgtaatggcaaccctgaaacgtctgtactggcacatatccggctgactggattgtgcggcaccggtacgaaaccgccagacctgattgccaccattgcatgttctgcctgccacgacgaaatcgaccgccgcacgcattttgttgacgctggatatgcaaaagaatgcgcgctggaaggtatggcgagaacacaggttatctggctgaaagagggggttattaaggcgtgaatacctacagcatcacattaccctggcctccgagcaataatcgctattaccgccataatcgcgggcgcacgcacgtcagcgcagaggggcaggcataccgcgataacgtcgcccgaatcattaaaaacgcaatgctggatatcggcctggctatgcctgtgaaaatccgcattgagtgccacatgccggatcgccgtcgccgtgacctggataatctgcaaaaagccgcttttgacgcactcactaaagcaggtttctggctggatgatgctcaggtcgttgattaccgcgttgtgaagatgcctgttaccaaaggtgggaggctggaactgaccatcaccgaaatggggaatgaatgatgtttgagtttaatatggcagaacttcttcgccaccgctgggggcgtctgcgcttatatcgtttccccggttctgttttgaccgattaccgaatactgaagaattacgccaaaaccctgacaggagcaggagtatgaagtcagagataacaatcaactaatactgttttgttgatttttgcttgtaattggcgttctggtctgatttttgtggagtaagttgatgcgtgatattcagatggttcttgagcgttggggagcgtgggcggctaataatcatgaagatgtgacctggtcgtccattgccgccggttttaagggattaattacttcaaaagtaaaatctcgcccgcaatgttgtgacgatgacgcgatgatcatttgcgggtgcatggcccgtctgaaaaagaacaacagcgatttgcacgatttattagtagattattatgtagtcggtatgacattcatgtcactggcaggtaagcattgctgctctgatggttatatcgggaaaaggttacagaaggctgagggcataattgaagggatgttaatggcattagatatccggttagagatggatatcgttgttaataactctaattaatatgccaattgtttactaaaaattattaaaaatggggcgttgagacgcccccaaaaataaagggtaatatataacagaaggtttatatagttagaagcaaggttgtgcttctaaaggaagtggcttgagggagccacttatatgttggggaggcaacgcctcccgcaacatatctttttcgtaatcagattagaactggtaaaccagacctacagcaacgatgtcatcagtgcttacaccgagtgctttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagtgaagtcatttttgtcaagcaggttgattttgtaatcaacgaaagtagacatatttttgttgaagtaataggttgcacctacatcaacatatttgactaagtcctgatcgccccatactccaagatccttacctttagattgcaggtaagcaacggacggacgcagaccgaaatcgaactgatattgtgcaacagcttcgaagttttgggctttattagcaacgaagtgatcagcaaatacagtcatattctgggtttcagaataggtagtggccaggtaaatgttgttagcgtcatatttcagacctgcggcccaaacttctgcatttttaccggaagcaaatacttcaggaagaactttccctgcattaacttgagtgtcggtacgatcagatttcgcataagttgcaccgataccgaatccttcgtattcataggtagcagagaaaccgaagccatcaccgttaccttcagtgtagttatcgaaatcgctacgatcgtttttgccttggtactgagcagcaaagttcagaccatcaaccagaccaaagaagtcgttgttacgataggttgcaacaccagttgcacgttgagtcatgaacacgtcggtttgagtccaagtgtcaccaccgaattctggcaggacgtcagtccacgcaccgatgtcgtatgctacaccgtagttacggccgtaatcgatggagccgtagtcaccgaatttcaggccagcgaaggcaagacgggttttatctttggaggaaccttgagattcagcgcggttgcctttgaattcatattcccactgaccgaaaccagtcagttgatcgttgatttgggtttcacctttgaagccaagacgggcataagtagtatcaccatcatctgcatcattagaggagaagtagtgcttagcattaactttcccgtacagatccagcttgttactgtctttattataaatttcagctgcctgagcagacatcgccattagtactgatgcagctacagcagaaattgccactgttaattttttcatcgtgagccctttttttgaactattattaaaaaatgatgtcactgcgcgataaatattcatctaatcaatgtgattatttcaagatgtaagttttggtttctcgtttgatttgtgaagtagatctctatttttatctgaacttttttctatcgaatcctattcatggctcttggctgaataaaaataaatctattagccaatttatattaacggctgttatttataagtgctctataatttgaaggttcaatttaaaccggctaaaaataacactggaaattattttttggttatttgttgagatttgcttatgtatttgtagtggtgttttcaatactcggtagcattctctcaaatatcatttagtggtttacgtacgtaaaaaattggttatgctgttaagagtggttacttcgtcacacagcttaaacccgccgtcgagcgggtttttccattttttgagtctcgatattagctgataacccaatacctgagttattcactgactccgagtctgttacgtttcgtagtattccctcaatttacacccgctttgtctgcgaggtggggttatgaaatccatggataagttaacaacgggtgtcgcctatggcacctcagcaggtagtgccgggtactggtttttacagctgctagataaagtcactccctcacagtgggcagcaataggtgtgctgggtagcctggtatttggcctgctgacgtacctgacaaacctttatttcaagattaaagaagataagcgcaaggctgcgagaggtgaataatgcctccatcattacgaaaagccgttgctgctgctattggtggcggagcaattgctatagcatcagtgttaatcactggcccaagtggtaacgatggtctggaaggtgtcagctacataccatacaaagatattgttggtgtatggactgtatgtcacggacacaccggaaaagacatcatgctcggtaaaacgtataccaaagcagaatgcaaagcactcttgaataaagaccttgccactgtcgccagacaaattaacccgtatatcaaagtcgatataccggaaacaacgcgcggcgctctttactcattcgtttacaacgtgggtgctggcaattttagaacatcgacgcttcttcgcaaaataaaccagggcgatatcaaaggcgcatgtgatcagctgcgtcgctggacatacgctggcggtaagcaatggaaaggcctgatgactcgtcgtgagattgagcgtgaagtctgtttgtgggggcaacagtgagcagagtaaccgcgattatatccgctctgattatctgcatcatcgtcagcctgtcatgggcggtcaatcattaccgtgataacgcaatcgcctacaaagtccagcgcgacaaaaatgccagagaactgaagctagcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccacggcctccggcgtggataatgcagcctccccccgactggcagacaccgctgaacgggattatttcaccctcagagagaggctgatcactatgcaaaaacaactggaaggaacccagaagtatattaatgagcagtgcagatagagctgaccatatcgatgggcaactcatgcaattattttgagcaatacacacgcgcttccagcggagtataaatgcctaaagtaataaaaccgagcaatccatttacgaatgtttgctgggtttctgttttaacaacattttctgcgccgccacaaattttagctgcatcgacagttttcttctgcccaattccagaaacgaagaaatgatgggtgatggtttcctttggtgctactgctgtctgtttgttttgaacagtaaatgtctgttgagcacatcctgtaataagcagggccagcgcagtagcgagtagcatttttttcatggtgttattcccgatgctttttgaagttcgcagaatcgtatgtgtagaaaattaaacaaaccctaaacaatgagttgaaatttcatattgttaatatttattaatgtatgccaggtgcgatgaatcgtcattgtattcccggattaactatgtccacagccctgacggggaacttctctgcgggagtgtccgggaataattaaaaacgatgcacacagggtttagcgcgtacatgtattgtattatgccaacaccccggtgctgacacggaagaaaccggacgttatgatttagcgtggaaagatttgtgtagtgttctgaatgctctcagtaaatagtaatgaattatcaaaggtatagtaatatcttttatgttcgtggatatttgtaatccatcggaaaactcctgctttagcaagattttccctgtattgctgaaatgtgatttctcttgatttcaacctatcataggacgtttctataagatgcgtatttcttgagaatttaacatttacaacctttttaagtccttttattaacacggtgttatcgttttctaacacaatgtgaatattatctgtggctagatagtaaatataatgtgagacattgtgacgttttagttcagaataaaacaattcacagtttaaatcttttcgcacttgatcgaatatttctttaaaaatggcaacctgagccattggtaaaaccttccatgtgatacgagggcgcgtagtttgcattatcgtttttatcgcttcaatctggtctgacctctttgtgttttgttgatgatttatgtcaaatattaggaatgttttcaattaatagtattggttgcgtaacaaagtgcggtcctgctggcattctggagggaaatacaaccgacagatgtatgtaaggccaacgtgctcaaaccttcatacagaaagatttgaagtaatattttaaccgctagatgaagagcaagcgcatggagcgacaaaatgaataaagaacaatctgctgatgatccctccgtggatctgattcgtgtaaaaaatatgcttaatagcaccatttctatgagttaccctgatgttgtaattgcatgtatagaacataaggtgtctctggaagcattcagggcaattgaggcagcgttggtgaagcacgataataatatgaaggattattccctggtggttgactgatcaccataactgctaatcattcaaactacttaacctgtgacagagccaacacgcagtctgtcactgtcaggaaagtggtaaaactgcaactcaattactgcaatgccctcgtaattaagtgaatttacaatatcgtcctgttcggagggaagaacgcgggatgttcattcttcatcacttttaattgatgtatatgctctcttttctgacgttagcctccgacggcaggcttcaatgacccaggctgagaaattcccggaccctttttgctcaagagcgatgttaatttgttcaatcatttggttaggaaagcggatgttgcgggttgttgttctgcgggttctgttcttagttgacatgaggttgccccgtattcagtgtcgctgatttgtattgtctgaagttgtttttacgttaagttgatgcagatcaattaatacgatacctgcgtcataattgattatttgacgtggtttgatggcgtagatgcacgttgtgacatgtagatgataattattatcattttgtgggtcctttccggcgatccgacaggttacggggcggcgacctcgcgggttttcgctatttatgaaaattttccggtttaaggtgtttccgttcttcttcgtcgtaacttaatgtatttatttaaaataccccctgaaaagaaaggaaacgacaggtgctgaaagcgagctttttggcctctgtcgtttcctttctctgtttttgtccgtggaatgtgcaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgctgcaggccagcgagacagatctccagccagggactattgagtacgaacgccatcgacttacgcgtgcgcaggccgatgcacaggagctgaaaaatgccagagactccgctgaagtggtggaaaccgcattctgtactttcgtgctgtcgcggatcgcaggtgaaattgccagtattctcgacgggatccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttattccagctggcttcgtggctgttttcaacagtgatgagtcatcgtggcatctcgttgaagatcatcggggtaaaacggtttatgacgtagcgtcaggggacgcgttatttatttctgaactcggtccgttaccggaaaatgttacctggttatcgccggaaggggagtttcagaagtggaacggtacagcctgggtgaaagatgcagaagcagaaaaactgttccggattcgggaggcggaagaaacaaaaaacagcctgatgcaggtagccagtgagcatattgcgccacttcaggatgctgtagatctggaaatcgcaacggaggaagaaacctcattgctggaagcctggaaaaaatatcgggtgttgctgaaccgtgttgatacatcaactgcacctgatattgagtggcctacgaaccctgtcagggagtaatcattgggattatgccgcagcacgtcttaagcaagaacatgctgcggttggatgctatttttttcctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaactccatcgccaagaattgtggctccgtatagagttccatcgtcagttaaggcctgcgccgcattgcgtattacacagctttttgtagatatatttccaggcaggcagtgaagaaggtaagacatggaaatggaatcaaattgaccatgtaacgccgcgggataaggttcaaaaacatcatggctaattttatgtttaatttttgattccccagcccttgtagatgccgcgttcaggctagcttcgttcaaatccattaaagatatcagactactctcaggtacgtgagtaaggtaaaacccagttccaacaccaatatccagatggttgttacctaaatgttccagaaagtgtggaagaaggtgttcctttgtaggacatccccatgcaagccgatttgatactcccaaaacccaccagtcataaagctttagggtaagtggtgtgtaaattctagccccatcatctgtgtttttttattaatttcaccatgttatagttttatttgtgaattaaatcaattatggcaatgaattacaaggggttaaatgctgccgcagcatagcgatattgaaatagcctggtatgcttcaatacagcaggagccgaatggctggaagaccgtcaccacacagttctacatccaggaattcagtgagtatattgcgccactgcaggatgctgtagatctggaaatcgcaacggaggaagaaagatcgttgctggaagcctgaaaaaagtatcgggtgctgctaaaccgtgtggacacttccgtagcaccagatatcgagtggcttattcaaccataataaacagtatgtatatcataggttattaattgtgagttttttcggtgtgttatttgtttgtttgatgttatgcttttgcgccccaaaaggttgtttagatgtattttatcaattgattttcaatatcgtttaataaagaaaaattaagcaagctggatgttggttttttgttaattgaatggttctaataatgtttttttactgttgttgaatgtgacttgataagaaatgcaagtaaaaatgatactctttttattttaaattcaaacggttgacatatatatagcaagaggtttcaggtgcgttgtagtgagtttatgttaataaaaagcatagtaagcgttgaaaaatgtaactttgaaataagttagaataaaaaacaacatacatataataatttaatcttaaatgaaatttattaaaatttgcaaactataattttgtgtataaaaatataaatgcacatcatcctgattatgattgtgtatttaattggttgttatttgactactatcaacttgttttaattttatgataggtgcaagatggattatgtttgctccgtagttttcatctgtcaatcatttgatttaattataaacaggagagttatctcgttcaaaaaaaattcattgtttattgtaagcgacaaaattagaagggagttaccagtatgcccctctaaactaagaattgttgatatagataagaaaacatgtttatccttttttatcgacgtgaataatgagctgcctggcaaatttactcttgataagaatggctatattgctgaagaggaacctccattatcgcttgttttttctctgtttgaagggattaaaatagcagactcacactccctttggttaaaagaaagactatgtatatccttacttgccatgttcaaaaaacgcgaaagtgtaaattcatttatactaacaaatataaatacatttacctgtaaaattactggaataatcagttttaatattgagcggcaatggcatttaaaagatattgcggaattgatttatacgagtgaaagtttaataaaaaaaagattaagggatgaaggaacgtcatttactgaaatattgagagatactaggatgaggtatgcaaaaaaactcataacttcaaactcttattctatcaatgtcgtagcccagaaatgtggctataacagtacttcatatttcatatgtgcatttaaagattattatggtgtcacgccatctcattattttgagaaaataatcggcgtcacagatggaataaacaaaacaattgactgataatgtttattacaagttgtctacatgttaattataatattatacagcgttttttttgatgtgatattctggaaccattaatttgtaattgggttgctgtcgcctattttatacatactataattgatggttttctatgtgatttagttaataaccttctgggtttattttaagggttaattgttacattgaaatggctagttattccccggggcgattttcacctcggggaaattttagttggcgttcttaaaatgtgtacttaagaccagcagtagtgatgaagttatagttttctatacctgctccatttttgctgtagtctgaagtgttattattgtgatcataaagtgaagtattaccttttttattcgtaacccgattccatgcgccttcaacataaacttttgcgttaggtgtgacgtaataacctgcattgactgcaacagaatagtaattttggtctttgaccttactgcgataagtgattctttttcccgggtcatagtgttcatcgttatcagatgattccacccagccgctgtatttaaatgtgccaccgagttcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcctgatcgaccatattgccacctcggctgccgagagttgtccagccagcagccccgatagatatctggggcatcaaatcccaattaattgcacctttaataattgcagcgttattgaatttccagtcgagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaataggggttgtcaggactattcccagaagtttcgcccgcataaaagttctccattcaatcgttttaatgattgaatatgtattttttatatctaacttaatgagtcaattacatattgctccactgtttatattttgtttagtattgaatgattatcacaatgcgctatctgtttttggtttaattatctgttattgtttcatatttcggttttactgtgtggtttttttatgcttttgtggtgcttttatctatttaagtgccatgcctttagaggcatataagcgaaaatagcatgaggtttatcctcaattactatgttttttagtacaaaaaagagggacaaaactgagacacataaggcctcgcaatggcttgcaaggctttacatgttttgaggtagtgggacgtgtgagcgcagagatggcgcggtaagttgttgacttaaaatgtcgttctaggaacttctaagtcgtgggccgcaggttcgaatcctgcagggcgcgccatttcttcctcatttatgcccgtcttatccgtttccgctttgcccttcaccacatcactttttgtcgctgtttggcgagataattcaacggtgtcaggccgtaaaacgccttaaaaacagagataaagtacgacgtgctgctatagccacataattgcgccacctgagtgatatttttgttatccatcaataacatctgtacggcgtaacgcatacgacactctgtgacaatctggctatagctggtattttcgttttttaatttctttttgagcaggctggggcttaaacatagcgaactggcgacaattcgcagattccagtaatgctgaatatcgctttgaataatgcggcagacgctgtcgcggacgctgctgcgtaagatatacatcagtagggcaataaaccgcgattgctcaagaaagttagacaatacggtaaaaagcaatgcgcgcgtcaactccgcttcgcagggtctgctgggttgctgcttgctgtggttggcggctagccggaacacttccggtgtacggctatgacaagcgataaccggggttgccagccgcgaccagggctttacacaggttaagttcttatttaaaaacaacagataatcgttgatgatgttacggttgatgtgggtgattaatacgtgatttaacgttgagagttcaatgacgttattgttgcacgcgaaggcggccaggtagtttttcggaagggtaaacgtagcatggttattgacgcttacctctacctctttttcggtcaggatcaccacgcaaggttcactgctgctcaattgcatttcgcactcctcagatatcagaaactccgctcaaaggatctatgcttcctgcatgagtgatcggcccgttcgccgataacgatcttctttctttagcacgctttttagcaattaatcttgatggaattctgatgagagcgaaagaggtaagccaggtcgtacccgacttacctggaggagatttaatactcgagaatgccgtgcgcgacgggcaaatagcgcagagagaaatagagagtgtctttaccgcaagaggaacgtttcgctaacagcgaggcaatttctgcgtccggtttcggtttcgctgtaaaggttttgcctttgccggcgacaaaaagttcataaacaacgccgctggcaggggcgggactttggcaatcggcgctggcctgtaaataacgttcacgctgttcagcggtcagtttatccacgccgctgccatcctgtacccagacattaacgccggttgctttaacgtgttccagcagttggcgatagccatcgggcgacatgtttccggcgaaaaaactactgatataaaccggttttgctgaaacatcgctaatcagccgctgcgcgttgtttaaccatgttagcaaaggctgacgggcggcttcgctgcgccagttcaggtcgtcaatttccgcgctgatgtaccagccatccggcgttatgccaggcgcggcgctccataatctggcttgctggagatcggcagccagcaggcgattaagatagctttccagcgctgcggacgactgtttctggtgcataaaaaattccggatcggcgttcagcccgacaataagcttcagaccagcctgttgcgcagctgcggcccgcttaaacaataacgtgcgctgttctggctgggtaaatgcatcgccgtaacgggtccattgcaaaacaagggtatcgaagccttgcaaacgtaactgactcatcagcccctgccactgggtatcggtaacctgactatctcggttttgtggttgccagataatacctttcatcgcaaaggaaaaagggctgaccaaaagcagtgtcagcaatacgaaaatgaacttacgcatttaccagtgcactccaatggtgagaaacgcgttgttgcgctctccgttacgttgattaatcgccttaaaggtatgttgatactcgacgccgagactgactttgtgcggccaggcgtcgtagtgcgtctcgccggtccagatattccagcggaccccgactccgccaagctgcgcgccctgagtgcctttatcacgatagccgttgtcctgaacgtgagcgtaaggctcaatagtctgtccgttagctaccttctgatgccagctgacgcgataatctgccgtccacgcctgaatatcctggcggatatattgcgccgcatcgaggtacaggttttgggcaaaccagcctgaaccgttcgggtgccattcgtcgctgtatttgccgccattaaagaatgaggcgctggcgcgcagcatggtatcggatgcgccattttggccgttcagcggcaactgctgttcgacggcgatgaaaaagatctgatcgcgcagcggcttccagcgcagaccggtgccggacatcggatttttcaccggcatcatcaccccgttttctccggtatcggcaaagacgcggctataaactgagagcaggtcgccttccagcagcatattgcgtccgatgcggtactcggcttccagttgtccgtagctacgatagcttttccctggcgctgcgccgccgacattattgttagcggtactcattgcgccggaacgcaagccgatggaagaatcgaaactgaacgtccagcggcgaccgacctcctcatgcaaacggcggaaattgaagcgttgttgattttgttctggggtcagtggggttatcagcgcctgattatcaatgtcatcaatcaccagccgggcgtagtgctgcgtcgcaggcatgtcatccagacgctggttcacgtaggccagttgtcggatcagtgccggatcgtccggaagccctttatgcgccggttcgagcatttcccgcgactgtgcgatatcaccgctatcccacaaggcgtaaccaagcgctgcctgggtgttgctattattcggttccagttccagcgcggcgcgcaaatcactcaccgcggccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgcttcccagtccacgtttttctgcctgttgtagccagcgatcgcgagccgcaccatttcctgccgcctgggcggtattggcagcagcaagcagatcctcattgctcatgtcgtgaagactgattttctgccaggccgccagtgcggtggcgtagtcctcaacctgatacgcctgataggctaccgcacgatgttgccaggcgctcggttgtcgttgttcggcctgaagccatgcatacaacgccacaccgggtagcgtgtcccgataacactttgccagacggttccaggcggcggcatcgtaggaaggcgacatatcgcccagcaagcgaactattgccgggcaattatctgcaatacccggcaactgactttgccactgacgttgctccgccagcggtaagggtttcgataaaatcgccaccttcgccggcgttgccaggtaaggatgactttccagcagagacgccagtcgcgccattaaagtctggctgacacgcgcatcgccctggaaaggatagcgttgcagcaataaatcggcagcttcgcgtgactgctcgttctgcatcagttgccaggttagttgatccaggcgggtaagatttgccggttcttgctgatacagcaatcgtgccagacgcagagcttcagccttgttacgggtcgccacgctgacagcataacgctcctcaagcatttcattggcggggagggtggcgagcagtttttgcgctgcgtcgtactgaccttcttttaacagcaccggtagcgtcgcgccaacaacatactggcggttgtcggcaaactgtaccgtataattcgccaacgcctgaacggggttagcgctgtatttagataacagatagagccaacttttctcttgtgcgtccgtggtaaatagtggcttattttcaatgagataatgctggaggcgtgctttttcgccacgataagccagcgcggtcgcgtaagtaatatatgactgaggatcggtgaagatcccctgtgattgcagtgccaggatccgatcgtccagctgcccggcaagaagcacgtcaaaccactgacggcgttctgccgcgcttaatgtgttctgctggcgtgcttcattgtatagcgtatctgcctgggaccattgtttcaggtagattgcccgttgcagcagatcggttcgcagcgtttttccttccggcgatgcagcaaacgtcgcatcgttcagttgcgctctggcgacaggtaactgtgccagccgcagggcattctgcccgacttcactgcgacaacgcagggtcggcgcagcatcgcacgctttttgctgggcaagcagttcttcaactgtcgtaacgcttttcacttcaaccggaatagccgccagactgcgctcaagtcgggcatctcctgggtgacgtttcagttgatcctcaagcaacagccgcgcccggtcatcatgaccaaaatggcgataggcttccgcaaggtataaagtcagcggaatattatccggcacctgctggtgtatatattcaaattcgcggatggcggttgcttcgtcgttatttttctgtgccttcagcgctttatcgagacggggataaataacaaaatggcgataatcgctcagccccagctcttctgcgctggtgccgatattgtctgcgagtgcgctggtactcaataaagacgtcagcagtaaaccagaccatccgatgacgcgattaaggttattctccttcattttcggactccagttgcgcaacctgttctgtgtttaaacctgctttgagtaatagtgattgcatcgaaacttgtaattcgcgttgaattgtcaggacgcgatccaacgtttcctggctgataacgccttcggtgaccaaaaacttgccgagcggcagagaactgcgttcatggcgcaataacaacacgttaattgctgaacgattaatatgaccgagcgtggtcagtatttcggcgaacaggaactgatgcggcacatattgccgccagatttcaccggcctgctgttccgtgagccactgatgctgaaccgcattgtacaacattgcccgcggatcgtgaccgcgtcggcgtgcataccagtgacgtaaccctgtgacaatttgtccccgcagaacaatgacgtaacgcactttgcgtccgactttacgcgtcagggccgccagcgaaaccgggtcaataccatcttcactgccgacaattaactcgtcattttccagacgcagcggcagtaccgcataatgcagcgccacggaggccggcatttcggcaatcagcgaggaagggatctgccaggcatcgatggattcccacgccacgccgttttgctctgccagcgcctgtgccagctgctcggcgctaatcagcccctgcatcagcattgaaccgcccaggcgtagaccttcgacgcgattacgcagtgctgtatcgagttgttcttcagtgatgacctgattttccagcagaatttgacctaacgggcgcaacgagcgggtatcgccagtcacgctggggaagtcatgcgttgttttatcccacgccacgcgacgtggatcgccgtgttgaagtacctgttttagcgcgcgccagttggccatgaagttaatcaggttgccccagaaaagacgcaggacggaaagcagcccctgcgtcaggccgtagtagccagtaacgaaaatcacccgctgcacgatgcggttaaccatcaaaccaaagtttagccacagcagggtcattaaccatgcgctgccgctgaaaatagaaaggaaatgccaggcatcgggccacaaactttcatacgccagcaacagcaaaagctggatcatcaccagcatcgcgaggaagctgacaaagttactgattgcccctttgcggtcgcgccagagaaagtagttcagcgtcaggctggaggtccatttatgggttttaaagccttggaaaacaatgccgatgatccagcgggatttttgtcgaaccgcagtcgaaaaggtatcggggaaatattcgcgcacgcagatcatgtttgatgtccgcgcgtgctgtaaaaatttacgctgctcgcgttctttggcttcgtccaccaccggaaaacggacaaaaatttccgtcatacctttttctttcaggcggaagccaatgtcgtaatcttcagtaagactctgcacgtcgaaagcaataccgtcaccgtcagctaacagtgcggtcacggcgcggcggctgaaacaggtgccgacgcctgcgctgggcacttgtccggcgagggcttcacgcaccggaacatctttgccatgcagctctgaaaactcatcaatgtaagtcatgctggtgaagtgcgtccattcgcgttcgaacggatacaccgggatctgaatcagatctttacgctcgaccagatagttgaacagacgcaattccatcggtgaaatcacatcttcggcgtcatgcagaataaaaccagcaaaagcgaaattggcgctacgctcaaattgggtgatggcgtccagcacgttgttcagacagtcggctttgctggtggggccaggacgcgcgcagactaccttatgcacattcgggaagcgagcgcacacttcgtcaacatcacgctgagtatcggggtcgttggggtaggtgccaacaaagatatgatagttttcgtagtcgagcgtggtcgccgccagctcggccatattgccgatgacgcccgtttcattccacgccggaaccataatcgctaacggtttttcatctggtttatacagttcgcggtaactcattcgcgggtagcggcgataaacactcaacttgcgtttaatgcggcgtacccagtagacgacatcaataaaaaaatcgtccagcccgctgatgaacatgatgaccgctaacgttatcgcgattacttttaagccgtagagccaggtagcaaaaacatcaagaagccagtccacacaaaaaccttacattaacgctggttatgtttagggtggcgtatattaaggttttttatgaattgtgacagctttttaccattaataggtatgactattgcggcacgttatttttacactggttataaaagttgccgtttgctgaaggattaagcgggtaatgtgataacaaaccttgtcccccgcgcatccgacgttaccgcaaccgtgcctttatgcgcgacaacaatcgatttcactatcgccaggccaataccgctaccttcaccttttcgctggcgggaggggtcaacgcgatagaaacggtcaaacaatcgcggtaagtgctcgggcgcaatgggcgtaccggggttttcgacgataacttgcaccaggtgatcgaccgtctgacagcgcactacaattgtctctccggttggcgtataacgcagggcgttcgaaagcaggttgcttagcgcccgacgcagcatcagcggatcgcccgcgacctgacacttgtcgccaacaaaccgcaactccacgccgcgatcttccgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgcgactggctgagggcgatttcggtttgcgttatgagattcgtaattggtgtgcgaatttcgtgagcgatatccgctgagaaattggactggcgggtaaagacatcctcaatacgctcgatcatatggttgaacgacagtaccagctgttccagctcaatgggcacggtctgcgggtcgaggcgaacgtcgagatctttcgaggtaatattctggatttgacggctgacgctgcggatcggcgcgtgacctttatgtaccgccaacagtacgataaagacgatcaggatgctgattaccgatgcggtcataataagtttattcatcaaatcatttatgtaatgaagatgaaaatcgatcgaaagcgcgatgtagagcgtataaatcggtttgccgtccaccaacgggccaaccggcaagttaatcatccgccagttgctgtgttccatatgcccgtgaccgtggcctggcatcatcatcgtcgggccggaaaggagatacacctcgccaccctgagcgtctttatcgggtatggcgtcacgcgtaaactcgcggatatccggcgcaccgggggagtgatacaccgttttaccctgactatctgccagggaaatcaacacattggaataaccactgacgatatcttccagcgtcattaagcgtcgggcttgcgtttcgtcagggtgatttagtacccgttcaagggtggcgctaatctcttttaaatcattaatatcctgctcggcaaaatgaacttttactgagtggatcatgatccatgcaaaggcgaaaaacgccgcgatggtggccaggctgataaaaaaggtcaggcgggttgccagcgaaaacgggcgctgaaatggcttactgaccatccggcacctcaagcatgtaacccacgccgcgcacggtctgaattagcttcggctcaaagtcgttgtcgattttgccgcgcagccgcttcaccgccacatcaatagcattggtatcgctgtcaaaattcatgtcccatacctgcgaggcgataagcgagcggggcagcacttcgccctgatggcgaaggaagaactccagcagagtaaactctttactggtcaaagtgatgcgcgtgccgctgcgggtgactttgcggctgacgagatcgaccatcaaatcggcaacctgaaactgactttcgataatcaccgccgccccgcgccgcagtaatgtgcgcacccgcgccagcagttcagcaaaagcgaatggcttcaccaggtagtcatctgcccccaactccagccccttgacgcgatgttcaatggtgccaagcgcggtaagcaacagaatcggcatccctttattggcggagcgtaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcatttttctgtcaccggaaaatcagagcctggcgagtaaagttggcggcataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactatcagaacgcgggctggcgcaccttttttgttgataatcaggtgaagacgctgattagcgaggcgctggtgaataatcgggatttgcgcatggcgacgctgaaagtgcaggaggcacgggcgcaatatcgtctgaccgatgccgaccgctacccacagctcaatggcgagggcagcggcagctggagcggtaatcttaaagggaataccgccacgacacgggagttttcgaccggccttaacgccagctttgacctcgattttttcggtcgcttaaagaacatgagcgaagccgagcgacaaaattatttagccactgaggaagctcagcgcgcggtgcatattctgctggtttctaatgtcgcgcaaagctatttcaatcagcaactggcgtatgcgcaattgcaaatagccgaagaaacgctgcgtaattatcagcagtcatatgcgtttgtcgaaaaacaactgttgacaggtagcagtaatgttctggcgctggaacaggctcgcggggtgatagaaagtacccgcagcgacatcgctaaacgtcagggggaactggcgcaggcgaataatgcattgcaactgttgctgggaagctacggcaagctgccgcaagcgcagacagtaaacagcgacagcctgcaaagcgttaaattaccggcgggattgtcgtcgcaaatcttattgcagcgcccggatattatggaagctgaacacgcgttaatggcggctaatgccaatattggcgctgcacgcgcggcattttttccgtctataagcctgaccagcggaatatcgaccgccagtagcgatctatcgtcattatttaacgccagcagcgggatgtggaattttatacccaaaattgagatccccatttttaatgccggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaattagcgcccagcagcgttatctggcatcgctgcaaattactttgcaacgggcgcgggcattatatcagcacggcgcagtaagttatctggaagtgctggatgccgagcgttctttatttgcaacccgacaaactttacttgatctgaattatgcccgtcaggttaacgaaatttctttgtataccgcacttggtggcggttgacagcaatatactcgtcatacttcaagttgcatgtgctgcgtctgcgttcgctcaccccagtcacttacttatgtaagctcctggggattcactcgcttgtcgccttcctgcaactcgaattatttagagtatgacttttaactccaggagagaataaatgaaaaaagcactgcaagtcgcaatgttcagtctgtttaccgttattggctttaatgcccaggctaacgaacatcatcatgaaaccatgagcgaagcacaaccacaggttattagcgccactggcgtggtaaagggtatcgatctggaaagcaaaaaaatcaccatccatcacgatccgattgctgccgtgaactggccggagatgaccatgcgctttaccatcaccccgcagacgaaaatgagtgaaattaaaaccggcgacaaagtggcgtttaattttgtccagcagggcaacctttctttattacaggatattaaagtcagccagtaacccaggtttaatgagatgaaaaaaatcgcgcttattatcggcagcatgatcgcgggcggtattatttctgcggcaggttttacctgggttgcaaaggcggaaccgcctgcagaaaaaacgtcgaccgcagaacgtaaaatcttattctggtacgacccaatgtatcccaatacgcggttcgataaaccaggtaaatcgccgtttatggatatggatctggtgccgaaatatgccgatgaagagagttctgcgtctggtgtgcgcattgacccgactcagacgcagaatctgggggtgaaaacggctaccgtcacgcgcggaccgctgacttttgcccagagtttcccggcgaatgtcagttacaacgagtatcagtatgccattgtgcaggctcgcgctgccgggtttatcgacaaggtgtatccgcttaccgtgggcgataaagtacaaaagggcacaccgcttctcgacctgaccattcctgactgggtggaagcgcagagtgagtatttactgctgcgcgaaaccggcggtacggcgacccagactgaaggcattcttgagcggctgcgactggcgggaatgccggaggcggatattcgccgcctgatcgccacgcaaaaaatccagactcgctttacgctcaaagcgcccattgatggcgtgatcaccgcgtttgatctgcgcgcgggaatgaatatcgccaaagataacgtggtagcgaaaattcagggtatggacccggtgtgggtcactgctgcgatcccggagtctatcgcctggctggtgaaagatgcctcgcagtttaccctcaccgttccggcgcgaccggataaaacactcaccatccgcaaatggacgctgctacctggcgtggatgccgcgacccgcacgctgcagctgcgtctggaagtcgacaacgccgacgaggcgctaaaaccgggcatgaacgcctggttgcaactcaacaccgccagcgaaccgatgctgctcattccgtcacaagcgctgattgataccggcagcgaacagcgggtgattaccgttgatgccgacgggcgctttgtaccgaaacgcgttgctgttttccaggcatcgcaaggcgtcaccgcattacgctctggtctggcggaaggtgaaaaggtggtttccagcggcctgttcctgattgattccgaagccaatatttctggcgcactggagcggatgcgctctgaaagtgctacccatgcgcattgagggaataaccaatgattgaatggattattcgtcgctcggtggcgaaccgttttttggtgctgatgggcgcgttgtttctgagcatctggggcacctggaccatcattaatacgccagtggatgcgctgccggatctctccgatgtgcaggttattattaaaaccagctatcccggtcaggcaccacaaatcgttgaaaatcaggtgacttatccgctaaccaccaccatgttgtcggtgcctggcgcgaagactgtgcgcggtttctcacagtttggcgactcttatgtgtatgtcattttcgaagatggcaccgatccgtactgggcgcgttcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattacaggactggtttctcaaatatgagctgaaaaccatccctgacgttgcggaagtggcgtcggtgggcggtgtggtgaaagagtatcaggtggttatcgatccccagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgcgatgttgcgaaggtccagattggcccggagatgcgccggggcattgccgaactaaacggcgaaggcgaagtggcgggcggggtggtgatcctgcgatccggcaaaaacgcccgagaagtgatcgccgccgtgaaggacaaactggaaacgctgaaaagtagtctgccggaaggcgtggagatagttacaacatacgatcgcagccagctcattgaccgcgccatcgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcacttccagggactgaatgccaatattatgtcgttgggtggcattgcgattgccgtcggggcgatggtcgatgctgctatcgtcatgatcgagaatgcgcataaacggctggaagagtggcagcaccagcatcctgacgccacgctggataataaaacgcgctggcaggtgatcaccgatgcgtctgttgaagtggggccggcgctatttatcagtctgctgattatcacgttgtcgtttatcccgatcttcaccctggaagggcaggaagggcgtctgtttggcccgttggcgttcaccaaaacgtatgcgatggcgggtgcggcgctgctggcgatcgtagtgatcccgatcctgatgggctactggatccgtggcaaaattccgccggaaagcagtaacccgctcaatcgctttttgattcgtgtttatcatccgctgttgctgaaagtactgcactggccgaaaaccacgctgctggtggcggcgctttcggtgctgacggttctctggccgctcaataaagttggcggggaatttttaccgcagatcaatgaaggcgacttgttgtatatgccatcgacgctgccggggatttccgcagcagaggcggcgagtatgctgcaaaaaaccgacaagctaattatgagcgtacctgaagtggcgcgggtatttggcaaaaccgggaaagcggaaaccgccaccgattctgctccgctggagatggtagaaacgaccatccagcttaagccgcaggagcagtggcggccaggcatgacgatggacaaaatcattgaggaactggataacaccgtgcggctgccggggctggcgaatctgtgggtgccgccaattcgtaaccgtatcgatatgctctcaaccggcattaaaagccccatcggcattaaagtttccggcactgtgctggcggatatcgacgcgatggctgagcaaattgaagaagtagcgcgaacggtgccaggcgtagcttctgcgcttgccgagcggctggaaggtgggcgctatatcaacgttgagattaaccgtgaaaaagccgcacgttacggtatgacggtggcggatgtgcagttgtttgtgacttctgcggtgggcggggcgatggttggcgaaacggtggaagggattgcccgttatccaattaatctgcgttatccgcaaagctggcgcgatagtccgcaggcactgcgccagctgccgatcctgacgccgatgaagcagcaaatcaccctggcagacgtggccgacattaaagtctctaccggaccgtcgatgctgaaaaccgagaatgcgcgcccgacgagctggatttatatcgatgcccgcgatcgtgacatggtgtcggtggttcacgatttgcaaaaagcgatagctgaaaaagtgcagttaaaaccgggcaccagcgtggcattctccgggcagttcgagctactggagcgcgccaaccataagcttaaactcatggtgccgatgacgttgatgattatcttcgtgctgttgtatctggcgttccgtcgggtgggcgaagcgttgctgattatcagcagcgtaccgtttgcgctggtgggcggcatctggttgctgtggtggatgggctttcatctttccgtggcgacgggcactggctttatcgccctcgccggggtcgccgccgaatttggcgtggtgatgctgatgtatttacgtcacgccatagaggccgtgccgtcgttgaataatccacaaacattcagcgagcagaagctggatgaggcgttatatcacggcgcggtcctgcgcgtgcgcccgaaagcgatgacggtggcggtgattatcgccggtctgctgccgattctgtggggaacgggggctggttcagaggtgatgagccggattgccgcgccgatgattggcggcatgatcaccgcacctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcgtgaaaaacgcgtcaaccgtatcggaagatactgcgtcgaatcaagagccgacgcttcatcgcggattacataaccgtcatattcaactgattgcgttgggtggcgcaattggtactggtctgtttcttggcattggcccggcgattcagatggcgggtccggctgtattgctgggctacggcgtcgccgggatcatcgctttcctgattatgcgccagcttggcgaaatggtggttgaggagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgttgattaaagtgctggcaatcatcggtatgatcggctttggcctgtggctgctgttttctggtcacggcggcgagaaagccagtatcgacaacctctggcgctacggtggtttcttcgccaccggctggaatgggctgattttgtcgctggcggtaattatgttctccttcggcggtctggagctgattgggattactgccgctgaagcgcgcgatccggaaaaaagcattccaaaagcggtaaatcaggtggtgtatcgcatcctgctgttttacatcggttcactggtggttttactggcgctctatccgtgggtggaagtgaaatccaacagtagcccgtttgtgatgattttccataatctcgacagcaacgtggtagcttctgcgctgaacttcgtcattctggtagcatcgctgtcagtgtataacagcggggtttactctaacagccgcatgctgtttggcctttctgtgcagggtaatgcgccgaagtttttgactcgcgtcagccgtcgcggtgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgtctggcgcatctgcgttttcgtgcagcgatgcgacgtcaggggcgtgaaacacagtttaaggcgctgctctatccgttcggcaactatctctgcattgccttcctcggcatgattttgctgctgatgtgcacgatggatgatatgcgcttgtcagcgatcctgctgccggtgtggattgtattcctgtttatggcatttaaaacgctgcgtcggaaataaggcattcacgctacatccgacaaaacgatgtcaaccatccgaaaccgctctcatccattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttagtaaacgcgtagatctcgagcggtaaaccgttatcacctggagccagttggcgtaccattaaggtcatatctttacgaatccgcggatggttacgcagatattcgttcagataggcacgaaaggttccaatattggtcattcggcgcagatttaataccgactccgtagaaccttgctggcgattccactcattaatttcctgatggcggctggttaaataaggctttaacaaatgcgctttattcagacgttgcatttcgtcttcatcaagaaaacgaatactggtgacatcaatactgatactgcgcttaatacgtcgcccgccagatgctgacatcccgctccagtttttaaaggagtcagaaaccagagaccaggtgggaatagtggtaatggtattgtcccagttacgcactttgacggtggttaacccaatatcgatcaccgcgccatccgcgccgtatttcggcatctccagccagtcgcccagtttcagcatatcgttcgcggaaagctgaatacctgccaccagaccaagaatcggatctttaaataccaacatcagcacggcagccattgcaccaagaccgctgatcagaatcgctggcgactgaccaatcagcagcgagatcatcaaaatgccgaccagaatcgcgccgatcagtttaatcccctgaaatatccctttcagcggtaactgagatgctgccgggaatttctgcgccagattcaaaataacatccagcaacgagaagactgaaagcagcgcatacatcatgatccacaactgcgcgcaggtagtcagaatatctgccgcttcggtgcctttttgcagccagaataccgcctgaatattgacgataatcccctgcagggtaaaagctaaacggtggaagagtttattctgggtaatgatttgcaaccaaagccgtgaactggcgatggcacgtttttcgaaggtccgcagtaccacccaatgcaaaataatatgcaccacgacggcggtcagaaaaataataccgaaaatcatcaccatcgaggtggtgtgatcgatctcaatacccgctaaatcttcaacctgggatattaaatcctgcataacgtctcctttatacaacagcagcctatgatgacggctgaaacagggttatgcaaatcaggagaatctgagaggaaatagccgggcagatgcccggcaagagagaattacacttcggttaaggtgatgttttgcggcagacgagatttcggcagcgtagcgttaaaatcttcaacgctgtgatgacctaccggaacaaccaccagactggtgtagcctttctctttcagaccaaattctgcatcgaggatggcggcgtcaaaaccttcgatgggtaccgcgtccagacccagagccgccacgccgagcaggaagttaccgacgttgagataaacctgttttgccatccactctgcatcatcatgcagatctttacggtgcatatcagcgaagaacttgcgacctttatcgttcgcggctttcgcttccggcgtggcaaagcggccatcggcatcttcctggtcaacaaccagcttcagccagacatcgtccatcgcggtttttgcacagaacaccacgacgtgcgaggcatcaagcattttacgctcgttgaacacgtaattaccggcagcggatttggcaacacgcgctttaccttcttccgtgctggcaacaataaaatgccacggctgggagttggtgctggatgggctgtattgcagtagcgttttgatctgctcggcctgttccggggtaagttttttgctggcatcaaatgccttagtggaatgacgctttaaggcgacagaaatgatatccataaagactccatgtgaaagtaattttgcgtgccagcagattacaaggttcaacgagaaatggtaagcgagaaaaatgcgctatagatttccgctttagcctggacgcactcttttttgatcgcgtttagccagaccatcaaccaccagattccacgaatcgttgatcagatcgcgaagtaacgcttcggagatttcttcgccgggatacactgaaatccagtgctttttattcatgtgataccctggcttaatgcttgggtatatttgctgatttaacagggatttttgtggatcggacttcagattgataaaggggacgccgcgtagctccgacgacagcataaaaatcttgccgccaattttaaaaacatcgaactccgggccaaaaggccagcaaagctcgacaaagggtaactcaagggccaggcgtttcgccgtttcgtgcagtgattgcttatccataaacgttcctttaggcgaaggagaataagcaaagtatgccgcgaagtacggcgataatcgacgtttaatccgccagcgagaaccagcgtcgccagataaagcgcagaacaaaatactcaatagcgcccagcactaaaaaccacagacaaaacaataaagtgtaaagctgactaagatccatcagatggaacatggtcaccagtttttgtgccagcgccagccccagtgcgggggcgggcagcagcaggcaagagaggaaagccatcagcaaaatgcctgctgcggtggtcaaggtttctaaagggtgtttcataacattgttaaatgtaagttaaaacaccattgtcagggatattcttctgtaaggcaattcccggcttagtcaccggcccagatctcacaatgctttttcaccagcccaatcagcgagccgccatcggcgacgaaatcgcgcattagctgcgcttcattcagaccgctgacgacctggcgatgcagggcctcaatcgcgctcgatgcaccaattttatgtgcggaaggggcgattttttccagcaatcgcaaggtatcttccgttagcggtcgacgatctccagtgtgcggatcggtgatgacgccttcaagcccatagcgacaggcctggaaacggttgaatttatacagcaggtaatctttttcctgatgtttaaacgggcgttccgtcagtaaccagtgggcggtagcctgaattaatcccgccatatttactgcgtggctaagggttaacggggtatccatcacccgaacctccaccgtgccaaaatgaggactggggcgaatatcccagtgcagatctttaatgctgtcgatcatcgtggtgtaactcagacagcgaaacagggcttcaaattgttgccagttactgacccacggcatcgggccattatcaggaaaggcggaaaaaatattcggtcgtgaggaggcaaaacgcgtatccgttccctgcatatatggcgacgcggcggaaagggcgataaagtgcggcacaaatcgtgacaagccgtgcagcaaataaatggcgtcatcgccactggcgcagccaacatggacatgctgaccaaaaacggtcgcctgctgaatgagataaccaaagttttccagcgtgcgttgatagcgttcgttatcgcatacctcctgacgctgccatttctgaaacgggtgcgtgccaccgccgcaaatttccagatgatggtctgtggctgcctgcaatacgactttctgcatcgctgaaaactgcccggcagcctggttgatatcacggcaaacatccgtcgccagctccagcatactttcggtgatatcgtgctttacctctccggccgtgatcttatttttaaccgcgtcaatcagcattgaagagtcctggcttaagtcatagcccggcggattaaccacctgcatttccagttcaataccgagggtaaaaggttcagaaacatgaaaatcgggtaatggcataggtttctcttatgttggcgttttctattcagtatagaagtcggagcggctgggcgagatgcggaagttctggaatgtttcttttttttggtgatggtgaactgatggtgcctgaagcaatttggctacttttgcaatgtgacaagttatggcagtgctgactggtggcgaagaattttgacgattgagtcatgcagaaaaaaacgggttcagcttcagttgattaaatgaggagtgagaagtccgaaacaggactcactgtataaataaacagctattttgttgaggaagggtaagataacggcgggtgcctgaagctttccggtttcaggtttactctgaggtctggaaagatgaagccccaggagatatttctatcaaccctggggctgccactccaaacccgaacaatttggatggtagtcccttcttcgcatggaggcaatataaacatgctgacgaaatatgcccttgcggcagtcatagtgctgtgtttaacggtgctgggatttacgcttctggtcggagactcgctgtgtgagtttacggtgaaggaacgtaatattgagtttaaggctgttctcgcttacgaaccgaagaagtagccgttgtgcggggagtaatcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggagtaatccccgcatatccggttgtcaggtcaggatggtaaggcacctgctttacactttcgcccgtggtcagtgatggctgcgggcgaatcgtaccagatgttgtcaattaatcgtgttggcacagcgttatgactatcttttcttttatctgccagtgcacagcaaacatctcattctcacgatgaatgatgacctgctgtttattccagctaattatctgatagtccagaaaacctgcatcagtttggatctcacttgccttaaatgcgctctctttggcggaaaatgccagtgtcagcgccagagaaaaggctaaaccgcagtctgcgagtcgctcgtgttccgctggtgtaataatgttgtctgtcaattctcttgcggtttgtacagaaaaaatttcttctatatcaatgccaatcggttgacgagataccacggctaatgccgtagtcccacagtggctaatactgccgtatacctccgcaggccagacaggttggcgtagctcgccgattgcgggcacacatttatagccatattcccgcaaagcataaacagcagcgatccgtccggctaaatgctctgttttacgtttacgtccagcgtgttgcagttgtgcgtagtgcggcagccagagtaaatcctgctcacaaaaattcgccggatcgaactcaacaaaatgcagcgtatgtccggcaaaggggagggaggtatgcgtagttttcatatcgaccatattcgagactgatgacaaacgcaaaactgcctgatgcgctacgcttatcaggcctacatggtcctgcaatatattgaattggcaagatttttgtaggccggataaggcgttcacgccgcatccggcatgaacgacgcgcactttgtcaacaatctgacgttagcatcagaagtgggtgtttacgctcatataccacgtacgtcccggctcgttataggtatacgccccggcaccggcgatatagttggcccctgccaaatcgcccgtggtctgggcattacccgcacgccacaaacgtttgtcgaacagattgtccacgccgccggtcagactgacattcttcgtcacatcccaggtcgcgctcaggccaacaatgctgtaaggactaatttctttggtttccggtccaaccgctggctgacctttatagttgtacttcttcggctgctgcttgccgtaccaggtgaaggtcgtttgcatcgacaaatcttcccgtgcctgccagctcagcgttgagttcaacgtatactccgggatgatcgacaaacggtcgcccgtggttttgttttcactcttcagcatataagtgatgttattggtccacatcaccgtttcgctaaccggtacgtttaacgatccttccagaccttcaaccaccgctttcggcacgttatcccactgatagagatcggtgccgactgcgttttgccctacagccacatagcccgcttcaatcttattgcgataatcgttacggaaccaggtgacgcccgccagccacccgtcgcgtttgaactccagaccaatctctttgttgatgctggtttctgctttcaggtcatcgttaccttgcagatagcagccgcccgcgctggcatagcaaccctgacctttactgtagagaatgtagttcgggttagtctggtacaggctcggcgctttataagcacgggcgatgcccattttcagcgtgaagtcatcgcctaaaccttgcgatatgttcagcgccgggctccagttattgccgacaatactgtgatgatcgaaacgcagccccggcgttacgatggtgctgtcagtcagctccatgttgttttcggcaaacagcgagaaaatttctgcttttgaatacgggctacggtcggtggtactcacgccatcaatagcgccaccggtattcgttccggtcagtgcctgggtgttggaacttaagtccttcatccgttgctgattccactccgtacccagcgtcagcgtctggttaacgaggaaatcaatcggcaggttaacttcgctgtgcagcatcacgtcatcaagatcgatatcgacgaaatcctgtgtcgctttttcgttaaatttcccttcggtaccgcccgccagaccttccggaatacgcgagttacgggtgtgttcgtactgcacccagttgctggtggtcacgccgttatcccagccaccgttccaggtcagcgcgtagttctggcgatacagacggttggtttcatcgccatatttcgagcgggtataggaatcggagttggtattctgggtgtcgcccgcatacaggttaccctggcggctgtaacctgcttccagttccagcgattgcaatggcgcgaaatcccagcgcaccacgccattaatatctttgttgattaccccttcgcgcccggctggtaacgtcgtggcatacgttccggcacgcgcggactgatggccctggttgatatcccacgcgtcagcctgggttttgtcgaggttgccatacaaacggaagctgaattcgtcgcccagcggaccggtcaggctaaagttagtgcgtttggtggcaccttcctctttatgttctggcgcattgaaatatgcgtcccaggagccgtgccactcgccgctgccttttttggtaatgatgttaaccacgccgcccgccgcgccgttgccataacgcgcagctgccggaccacgcagaacttcaatacgttcaatcatttcaggtggcacccaggaagtatcaccacgggtatcgcgctcgccacgccagccctgacgcaccgagttacggctgcttaccggcttgccgtcaatcaaaatcagcgtgttttccggacccataccgcgaatatcaatctgtcggttattcccacgctgaccactggtggagttaccggtcaggttaacgcctggcatggtacggatgatcttcgacacatcgcgggcaaccgggtttttgcggatttcatctgcggtgatggtcgaaacgccaggcgcctgtaagttctgctcggcggcggtaacgacaatagtatcgtcatgtgaaacaggagtatcggtcggctcttgtgcctgcgctaccccataaatccccagattgaccaacaaggccagggaatgaatcttcttgttcattgttttattcctgcatttttgccacgaattgcaactgtcgggcatggtcgtcatcaacacgacgcatcccgctaccgcgaaaacctttgatcctgaaagacacgcagtgcagttggttaattaatgtccgcgcttcccacggcgcgccattacgctattgcaaatgcaaatagttatcaataatattatcaatatatttctgcaatcaatgaaaaattgcacagtaaacatggggttatggtgtgacggcgttaaaagtaggaagtgagagctggtggcagtcgaaacatggcccggaatggcagcgtctgaatgacgaaatgtttgaggtcactttctggtggcgtgatccccaaggttctgaagaatactcgacgataaagcgcgtatgggtctacatcactggtgtgaccgatcaccatcagaacagccagccccagtcgatgcagcgaattgcaggcactaacgtctggcagtggacgacacaactcaatgccaactggcgcggcagctactgctttattcccaccgaacgcgatgacattttttctgtaccatcccccgatcgcctcgaattgcgcgaaggctggcgaaaactattaccccaggcgatagccgatccgctgaacctacaaagctggaaaggcgggcgagggcacgctgtttctgcactcgaaatgccgcaagcgcctctgcaaccgggatgggattgtccgcaagcgccagaaatacctgccaaagaaattatctggaaaagtgaacggttgaaaaagtcacggcgtgtatggatttttaccaccggcgatgcaacagcagaagaacgcccgctggcagttttgctcgatggcgaattttgggcgcaaagtatgcccgtctggccagtgctgacttcgctgacccatcgtcagcaacttcctcccgccgtgtatgtgttgatcgacgctatcgacaccacgcaccgcgcccacgaactgccgtgtaatgcggatttctggctcgcagtacagcaagagttattacccctggtgaaagctattgccccttttagcgatcgtgccgatcgcaccgtggttgccgggcagagttttggtgggctttccgcgctgtatgccggactgcactggcctgaacgctttggctgtgtattaagccagtcaggatcgtactggtggccgcatcggggcgggcagcaagagggcgtgttacttgaaaagctaaaagctggtgaagttagcgccgaaggtctgcgcattgtgctggaagcgggtattcgcgagccgatgatcatgcgggccaatcaggcgctgtatgcgcaattacaccccataaaagaatccattttctggcgtcaggttgacggcggacatgatgcgctttgttggcgcggtggcttgatgcaggggctaatcgacctctggcaaccacttttccatgacaggagttgaatatggcattcagtaatcccttcgatgatccgcagggagcgttttacatattgcgcaatgcgcaggggcaattcagtctgtggccgcaacaatgcgtcttaccggcaggctgggacattgtgtgtcagccgcagtcacaggcgtcctgccagcagtggctggaagcccactggcgtactctgacaccgacgaattttacccagttgcaggaggcacaatgagccagcatttacctttggtcgccgcacagcccggcatctggatggcagaaaaactgtcagaattaccctccgcctggagcgtggcgcattacgttgagttaaccggagaggttgattcgccattactggcccgcgcggtggttgccggactagcgcaagcagatacgctgcggatgcgttttacggaagataacggcgaagtctggcagtgggtcgatgatgcgctgacgttcgaactgccagaaattatcgacctacgaaccaacattgatccgcacggtactgcgcaggcattaatgcaggcggatttgcaacaagatctgcgcgtcgatagcggtaaaccactggtctttcatcagctgatacaggtggcggataaccgctggtactggtatcagcgttatcaccatttgctggtcgatggctttagtttcccggccattacccgccagatcgccaatatttactgcacatggctgcgtggcgaaccaacgcctgcttcgccatttacgcctttcgctgatgtagtggaagagtaccagcaataccgcgaaagcgaagcctggcagcgtgatgcggcattctgggcagaacagcgtcgtcaactgccgccgcccgcgtcactttctccggcacctttaccggggcgcagcgcctcggcagatattctgcgcctgaaactggaatttaccgacggggaattccgccagctggctacgcaactttcaggtgtgcagcgtaccgatttagcccttgcgctggcagccttgtggctggggcgattgtgcaatcgtatggactacgccgccggatttatctttatgcgtcgactgggctcggcggcgctgacggctaccggacccgtgctcaacgttttgccgttgggtattcacattgcggcgcaagaaacgctgccggaactggcaacccgactggcagcacaactgaaaaaaatgcgtcgtcatcaacgttacgatgccgaacaaattgtccgtgacagcgggcgagcggcaggtgatgaaccgctgtttggtccggtactcaatatcaaggtatttgattaccaactggatattcctgatgttcaggcgcaaacccataccctggcaaccggtccggttaatgaccttgaactggccctgttcccggatgtacacggtgatttgagtattgagatcctcgccaataaacagcgttacgatgagccaacgttaatccagcatgctgaacgcctgaaaatgctgattgcccagttcgccgcggatccggcgctgttgtgcggcgatgtcgatattatgctgccaggtgagtatgcgcagctggcgcagctcaacgccactcaggttgagattccagaaaccacgcttagcgcgctggtggcagaacaagcggcaaaaacaccggatgctccggcgctggcagatgcgcgttacctgttcagctatcgggaaatgcgcgagcaggtggtggcgctggcgaatctgctgcgtgagcgcggcgttaaaccaggggacagcgtggcggtggcactaccgcgctcggtctttttgaccctggcactccatgcgatagttgaagctggagcggcctggctaccgctggataccggctatccggacgatcgcctgaaaatgatgctggaagatgcgcgtccgtcgctgttaattaccaccgacgatcaactgccgcgctttagcgatgttcccaatttaacaagcctttgctataacgccccgcttacaccgcagggcagtgcgccgctgcaactttcacaaccgcatcacacggcttatatcatctttacctctggctccaccggcaggccgaaaggggtaatggtcgggcagacggctatcgtcaaccgcctgctttggatgcaaaatcattatccgcttacaggcgaagatgtcgttgcccaaaaaacgccgtgcagttttgatgtctcggtgtgggagtttttctggccgtttatcgcaggggcaaaactggtgatggctgaaccggaagcgcaccgcgacccgctcgctatgcagcaattctttgccgaatatggcgtaacgaccacgcactttgtgccgtcgatgctggcggcatttgttgcctcgctgacgccgcaaaccgctcgccagagttgcgcgacgttgaaacaggttttctgtagtggtgaggccttaccggctgatttatgccgcgaatggcaacagttaactggcgcgccgttgcataatctatatggcccgacggaagcggcggtagatgtcagctggtatccggcttttggcgaggaactggcacaggtgcgcggcagcagtgtgccgattggttatccggtatggaatacgggtctgcgtattcttgatgcgatgatgcatccggtgccgccgggtgtggcgggtgatctctatctcactggcattcaactggcgcagggctatctcggacgccccgatctgaccgccagccgctttattgccgatccttttgccccaggtgaacggatgtaccgtaccggagacgttgcccgctggctggataacggcgcggtggagtacctcgggcgcagtgatgatcagctaaaaattcgcgggcagcgtatcgaactgggcgaaatcgatcgcgtgatgcaggcgctgccggatgtcgaacaagccgttacccacgcctgtgtgattaaccaggcggctgccaccggtggtgatgcgcgtcaattggtgggctatctggtgtcgcaatcgggcctgccgttggataccagcgcattgcaggcgcagcttcgtgaaacattgccaccacatatggtaccggtggttctgctgcaacttccacagttaccacttagcgccaacggcaagctggatcgcaaagccttaccgttgcctgaactgaaggcacaagcgccagggcgtgcgccgaaagcgggcagtgaaacgattatcgccgcggcattctcgtcgttgctggggtgtgacgtgcaggatgccgatgctgatttcttcgcgcttggcggtcattcgctactggcaatgaaactggcagcgcagttaagtcggcaggttgcccgccaggtgacgccggggcaagtgatggtcgcgtcaactgtcgccaaactggcaacgattattgatgctgaagaagacagcacccggcgtatgggattcgaaaccattctgccgttgcgtgaaggtaatggcccgacgctgttttgtttccatcctgcgtccggttttgcctggcagttcagcgtgctctcgcgttatctcgatccacaatggtcgattatcggcattcagtcaccgcgccccaatggccccatgcagacggcggcaaacctggatgaagtctgcgaagcgcatctggcaacgttacttgaacaacaaccgcatggcccttattacctgctggggtattcccttggcggtacgctggcgcagggtattgcggcgcgactgcgtgcccgtggcgaacaggtggcatttcttggcttgctggatacctggccgccagaaacgcaaaactggcaggaaaaagaagctaatggtctggacccggaagtgctggcggagattaaccgcgaacgcgaggccttcctggcagcacagcagggaagtacttcaacggagttgtttaccaccattgaaggcaactacgctgatgctgtgcgcctgctgacgactgctcatagcgtaccgtttgacggtaaagcgacgctgtttgttgctgaacgcacacttcaggaaggtatgagtcccgaacgcgcctggtcgccgtggatagcggagctggatatctatcgtcaggattgtgcgcatgtggatattatctctccagggacgtttgaaaaaattgggccgattattcgcgcaacgctaaacaggtaaattaatattatttataaacccataattacagaaaataattatgggttttttatttgtttgatttataggtttgatgaatatttctcttaaatagagtgaatgttgcattcagtggaaggaatttacaaacttcagcttcggataattatcaccaactggtaaagtgagcgccgtggagatttccccctattggactcattttcaggttataccccatgtcatcactgaatattaaacagggaagtgacgctcattttcccgattatcctctggcgtcgcccagtaataatgaaattgatttacttaatctaatctcagttttatggcgggccaaaaaaacggtcatggcggtcgtttttgcgtttgcctgcgcaggcttgctgatctctttcatcctgccgcaaaaatggaccagcgcggcggttgtcacgcctccagaacctgttcagtggcaagagttggagaaatcattcactaagcttcgtgtgctggatctggatatcaaaattgatcgtacagaagcatttaacctgtttatcaagaagtttcagtcggttagcttgctggaagagtacctgcgttcatcaccttatgtgatggaccaattaaaagaggcgaaaatcgacgaactggatttgcatcgcgcaattgtcgcattgagcgaaaaaatgaaagcggttgatgacaatgccagtaagaaaaaagatgaaccgtcactgtatacctcctggacgctaagttttaccgcgccaaccagtgaagaggcgcagaccgttttgagcgggtatatcgattatatctctacgttggtggtgaaagagtcgctagaaaacgtccgtaataaactggagatcaaaacccagtttgaaaaagaaaaactggctcaggatcgcattaaaacgaaaaatcaacttgatgcaaacattcagcgcctcaattattcactcgacattgccaacgcggcaggaattaaaaagcccgtttacagtaatggtcaggccgttaaagatgaccccgatttttctatttctctcggtgcagacggtattgaacgcaaactggaaatagaaaaagcggtcactgacgttgcggaactgaacggtgaattacgtaatcggcagtatcttgtcgagcaattaacaaaagcacatgtcaacgatgtgaattttacgccgtttaaatatcagttaagcccgtcattgccagtgaaaaaagacggtccgggtaaggcgattattgtgatcctttccgcgttgatcggcgggatggtggcttgtggtggcgtgctgttgcgctatgcgatggcatccagaaaacaggatgccatgatggcagaccacttagtttaactatttgcggttgaaggtgccgttcgtccgagcggcaccacaagcggcgttccggcaactggatcgtcaatgatcatgcagcgcagaccataaatgcgctcaatcagttcagcagtgacaatctccttcggcgctccctgagcaacaattttcccttcccgcaatgcaatcaaatggctggcgtaacgacaggcctgattaagatcgtgcagcaccgccgccagggtatagcctttttcgcggttcagttcgcttaacaactccagcaaatcaatctgatgactgatatccagccaggtcgtgggttcgtcgagcagcataattgccgtttcctgggccagcaccatcgcgatccacgctcgctggcgttgtccgccagaaagggtatccacgctttgatctgccagatgagttattcccgtggcctgcattgctttcgttaccgcttcttcatcctctttgcgccagcgggtaaacagcggttgatgcggataacgtccacgcgccaccagctcctgcacggtgatatcgcccggcgtggtagcattttgcgccaacagaccaatccggcgtgcaacctctttactggcgtaatgttgaatgtgctcgccatccagccagacatgcccatgagcaggcgtcatcaggcggcttaaggtacgcagtaacgtggatttaccgcagccatttggcccgataattgccgtgaagtgaccatcaggtatttctacagtcagattttccgcaacggtatatttgccatatcccagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccgccagcagtaacagcgccccgcatagcgccgcctgggttagcccccagcgagcggtgccgctaatgcgtcgggcaatgtgcggtgcgactaaagcaataaaggaaatcggcccggcaagcgctgttgccgcagcggtaagcaccactgcaaccagcatcattaacagacgcgaacgttcgacgctgacgcccagcgcacacgcggtatcatcgcccatttccagcaagcgcatccggcgtaccagtaaggcggcggcaatgagcatcaatataatgatgggtgcggaaggcgaggtttttgcccacgtcaggccgttgagcgatccggcattccacaaacctgctgttagcgccgtttctaaagacgctttcagcaacagccaggtattaaaggccaccagcatggcgcgaacgccgataccgataataatcaaccgaaaggtgtcgatgccgttgcgccaggcgagcagccagaccagcagcgaagtgacaatgccgcccaccattgctgacagcgcgatagccgtcaggtcctgaccaaacagcaccatcgccaccagcacgccgctccacgccccggtgttaaagcccattacgtcagggctgccgagcgggttacgcatcagcgactgaaaaatcgcgccactgacgcccagtgctgcgccaatcaacagcgccatcagcacgcgtggtaaacgccattcggtgaccaccatcgtcatactgcgcggcgcatcgcccatcagcgcggcgaatacctgcgaggtttccagcgtgacggcaccgctgcgtaatccccagatacctgcaaccacacaggcggaaaccagcagcaaacaggtgatgagtaatcggcgagagacgtaaatcatgcaccacctcgcgttttacgtcgcacgaggaagatcagcaccggtgcaccaataaacgcactgaccacagaaacgcgcagttcgccgggcacaatcacccgcccgatgatatcggcaaacagcagcagggcaggggtagcaagtagcgtgacgggcagcgaccagcgatgatcggcacccaccagccaacgcgccatatgcggcatcatcaggccaataaaggcaatcgggccaactattgccgtcgcactaccacaaagcacggtaatcgccagcagaccaatcaactgtgtgcgcgccacgcgactgcccagcgccgtcgcggtgtcgctgccgaggctcaaactgttcagcgcgcgactcagtaatagcgcagttgctccggcgatcagcaccgggatcagcaccacttttaaggtatgtagattgcgaatatccagcgaaccggcttgccagaaacgcaactgatcgtagacgtcaggattaagcagggcgatgccgctggtcagtccttccagcaccgccgccagcgccacgcccgccagggttaaacgcaccggacttaactgcccgccgccctgactgccggtaaaggcaacaatcaatgaggccaccagcgccccggcgaaggccatcgccagttgttcctgcgcggaagagtaaccaaacagcgccgcacccagcacaatggcaaagctggctccggcgttcacgccaagcaagccggggtcggcaagtgggtttcgggtgagggtttgcattaacgccccggcaaggccaagcgcgccgcctgccagtaaaccggcaagggtacgcggcagccgcgcgtcgagcacgatggtgcagtcggcgctctggcaggtgccggagaaggcctccagcactacggaagcggggagtgattttgccccaatgagcaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaataggtatttaaaatatttgatggcaaggcattgtaatgaataaacaatcctggctgcttaacctcagcctgttgaaaacgcacccggcgtttcgcgcagtattcctcgctcgtttcatctcaattgtgtctctgggtttgctcggcgtcgcggtgccggtgcagatccagatgatgacacattccacctggcaggtggggctttcggtgacgctgaccggcggcgcgatgtttgttggcctgatggtcggcggtgtgctggcggatcgctatgagcgcaaaaaagtgattttgctggcgcgcggcacctgtggcattggcttcattggactgtgccttaatgcactgctgccggagccgtcattgctggcaatctatttacttggtttatgggatggttttttcgcatcgcttggcgttacggcgctattggcggcgacaccagcactggtagggcgtgaaaacttaatgcaggccggggcgatcaccatgttgaccgtgcgtctggggtcggtgatttcgcccatgattggcggtttattgctggcgaccggtggcgtagcctggaactacgggctggcggcggcgggcacgtttattaccttgctaccgttgttaagccttccggcgttgccaccgccaccgcagccgcgtgagcatccgttgaaatcattactggcaggatttcgttttctgcttgccagcccgctggtgggcgggattgcgctgctgggtggtttattgacgatggcgagcgcggtgcgggtactgtatccggcgctggctgacaactggcagatgtcagcggcacagattggttttctctacgcggcgatcccgctcggcgcggctattggtgcgttaaccagcgggaagctggcacatagtgcgcgaccagggttattgatgctgctctccacgctgggatcgttcctcgccattggtctgtttggcctgatgccgatgtggattttaggcgtggtttgtctggcgctgttcggctggttgagtgcggtcagctcgttgctgcaatacacaatgctgcaaacgcaaaccccggaagcgatgttagggcggattaacggtttgtggacggcgcagaacgtgacgggcgatgccataggcgcggcgctgctgggtggtttgggcgcgatgatgacaccggttgcttccgcaagcgcgagcggttttggtttgttgattatcggcgtgttgttattgctggtgctggtggagttgcgacattttcgccagacgccgccgcaggtgacagcgtccgacagttaatgcttaaaacagcgccttaagcctatccagcacttgcatggcgctgtagtaatccagacggaacgtctcggttcccagcgcataaacctgcttgttttgtactgcaggcaggtgcgcgagcagcggattagcataaatagcatcggcatctttctgatcaccggcgaacaggaatagtgactcgccatttaaccctgcagccagattttccccaccaagctgaatgatgtcatggcgtttaccctgactttggctggcatttaaccctgcgggtaacttcgccagcgtaaagccgagttgttccagcatctgcccttgtgctgattctggcgtccagagattggcactgtgtgcagcggcagtatagacaatggcagtgaccggctgcggcggtaatttgatttgctctttcgccgccgccagttgcttatcaaactgcgcaatccgctctgccgcttgtttctcatgcccggtaatttcgccaagttgcgttaacagcgactgccagcttttgtcgtcgtaattgatgattaatgtcggggcgatggtggaaagctgatcatacagtgccagcgccgaatccccgccggttgcgctaattaaaatcagatccggcatttgcgcggcaacggcttcggcgctcggttcgccgatatagagccgttgcagtttgcgttctttcgccaccttgctccactggcgtaaaaagccctggtcatccgcgacgcggttattcggcgtggtcgcgccgctggcgatcaccggagcatcaatcgccagcagtgagccggtcagggtgacgctggtggaaacaatacgctgcggctggctttccagtgtatgtgtgccacggctgtcagtaatctgacgcggccagtcagcggcctgaactgcggctattcctgaaagcaaaagtcctgttaatagaagggcgttgcggtagagcggggcgagtctcacaaatcagcttcctgttattaataaggttaagggcgtaatgacaaattcgacaaagcgcacaatccgtcccctcgcccctttggggagagggttagggtgaggggaacagccagcactggtgcgaacattaaccctcaccccagccctcaccctggaagggagagggggcagaacggcgcaggacatcacattgcgcttatgcgaatccatcaataatgcttctcattttcattgtaaccacaaccagatgcaaccccgagttgcagattgcgttacctcaagagttgacatagtgcgcgtttgcttttaggttagcgaccgaaaatataaatgataatcattattaaagcctttatcattttgtggaggatgatatggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgctgtttgccgatgccaaagcgcagggcatcaaaaatccggtgatggtcggggcgattcccttcgatccacgtcagccttcgtcgctgtatattcctgaatcctggcagtcgttctcccgtcaggaaaaacaagcttccgcacgccgtttcacccgcagccagtcgctgaatgtggtggaacgccaggcaattccggagcaaaccacgtttgaacagatggttgcccgcgccgccgcacttaccgccacgccgcaggtcgacaaagtggtgttgtcacggttgattgatatcaccactgacgccgccattgatagtggcgtattgctggaacggttgattgcgcaaaacccggttagttacaacttccatgttccgctggctgatggtggcgtcctgctgggggccagcccggaactgctgctacgtaaagacggcgagcgttttagctccattccgttagccggttccgcgcgtcgtcagccggatgaagtgctcgatcgcgaagcaggtaatcgtctgctggcgtcagaaaaagatcgccatgaacatgaactggtgactcaggcgatgaaagaggtactgcgcgaacgcagtagtgagttacacgttccttcttctccacagctgatcaccacgccgacgctgtggcatctcgcaactccctttgaaggtaaagcgaattcgcaagaaaacgcactgactctggcctgtctgctgcatccgacccccgcgctgagcggtttcccgcatcaggccgcgacccaggttattgctgaactggaaccgttcgaccgcgaactgtttggcggcattgtgggttggtgtgacagcgaaggtaacggcgaatgggtggtgaccatccgctgcgcgaagctgcgggaaaatcaggtgcgtctgtttgccggagcggggattgtgcctgcgtcgtcaccgttgggtgagtggcgcgaaacaggcgtcaaactttctaccatgttgaacgtttttggattgcattaaggagcgaggatgagcattccattcacccgctggccggaagagtttgcccgtcgctatcgggaaaaaggctactggcaggatttgccgctgaccgacattctgacgcgacatgctgcgagtgacagcatcgcggttatcgacggcgagcgacagttgagttatcgggagctgaatcaggcggcggataacctcgcgtgtagtttacgccgtcagggcattaaacctggtgaaaccgcgctggtacaactgggtaacgtcgctgaattgtatattacctttttcgcgctgctgaaactgggcgttgcgccggtgctggcgttgttcagccatcagcgtagtgaactgaacgcctatgccagccagattgaacccgcattgctgattgccgatcgccaacatgcgctgtttagcggggatgatttcctcaatactttcgtcacagaacattcctccattcgcgtggtgcaactgctcaacgacagcggtgagcataacttgcaggatgcgattaaccatccggctgaggattttactgccacgccatcacctgctgatgaagtggcctatttccagctttccggtggcaccaccggcacaccgaaactgatcccgcgcactcataacgactactactacagcgtgcgtcgtagcgtcgagatttgtcagttcacacaacagacacgctacctgtgcgcgatcccggcggctcataactacgccatgagttcgccaggatcgctgggcgtctttcttgccggaggaacggttgttctggcggccgatcccagcgccacgctctgtttcccattgattgaaaaacatcaggttaacgttaccgcgctggtgccacccgcagtcagcctgtggttgcaggcgctgatcgaaggcgaaagccgggcgcagcttgcctcgctgaaactgttacaggtcggcggcgcacgtctttctgccacccttgcggcgcgtattcccgctgagattggctgtcagttgcagcaggtgtttggcatggcggaagggctggtgaactacacccgacttgatgatagcgcggagaaaattatccatacccagggttacccaatgtgtccggatgacgaagtatgggttgccgatgccgaaggaaatccactgccgcaaggggaagtcggacgcctgatgacgcgcgggccgtacaccttccgcggctattacaaaagtccacagcacaatgccagcgcctttgatgccaacggtttttactgttccggcgatctgatctctattgatccagagggttacatcaccgtgcaggggcgcgagaaagatcagattaaccgtggcggcgagaagatcgctgccgaagagatcgaaaacctgctgctgcgccacccggcggtgatctacgccgcactggtgagcatggaagatgagctgatgggcgaaaaaagctgcgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctgaaggagagaacacgatggctattccaaaattacaggcttacgcactgccggagtctcacgatattccgcagaataaagttgactgggcctttgaaccgcaacgtgccgcgttgttaatccatgatatgcaggactattttgtcagcttctggggcgagaactgcccgatgatggagcaggtgatcgcgaatattgctgcgctgcgcgactactgcaaacagcacaatatcccggtttattacaccgcccagccgaaagagcagagcgatgaagatcgggcgctgttgaatgatatgtgggggccgggcctgacccgctcgccggaacagcaaaaggtggtggatcgcctgacgccagatgccgacgacacggtgctggtgaagtggcgctacagcgcgtttcatcgttctccgctggagcaaatgctgaaagagagtggacgtaaccagctgattattaccggggtatatgcccacattggctgtatgaccaccgcaaccgacgcatttatgcgcgatattaaaccgtttatggtggcggatgcgctggccgatttcagccgtgacgagcatttgatgtcgctgaaatatgtggccggacgttctggccgggtggtgatgactgaagaattactgccagcacctatccccgccagcaaagcggcgctgcgtgaggtgatcctgccgttgctggacgagtccgatgaaccgttcgatgacgacaacctgatcgactacggtctggattcggtgcgcatgatggcgctggcggcgcgctggcgcaaagtgcatggtgatatcgactttgtcatgctggcgaaaaacccgaccatcgacgcctggtggaagctactctcccgcgaggtgaaataatggatttcagcggtaaaaatgtctgggtaaccggcgcaggtaaaggtatcggctacgccacggcgctggcgtttgttgaggcgggagcgaaagttacaggttttgatcaagcgttcactcaggagcaatatccctttgcgaccgaagtgatggatgttgccgacgctgcgcaggtcgcgcaagtgtgtcagcgactgttagctgaaacggagcgactggacgcgctggtcaatgcggcgggaattttacgcatgggcgcgaccgatcagctcagtaaagaggactggcagcagacttttgcggttaacgtcggcggtgcgtttaacctgttccagcaaaccatgaaccagtttcgccgtcagcggggcggggcgattgtcactgtggcgtccgacgccgcgcacacgccgcgtattggcatgagtgcttatggcgcatcgaaagcggcgctgaaaagcctggcgttgagcgtcgggctggaactggcgggtagcggcgtgcgctgtaatgtggtttcgcctggctccaccgacaccgatatgcaacgcacgctgtgggtgagcgatgacgccgaagaacagcgtattcgcggctttggcgagcagtttaaactcggcattccgctggggaaaatcgcccgtccacaagagatcgccaacacgattttgttcctcgcctctgacctcgccagccatattaccctacaggatattgtggtcgatggcggctcaacgctgggggcataagcatgatctggaaacgccatttaacgctcgacgaactgaacgccaccagcgataacacaatggtggcgcatctgggaattgtgtatacccgtctgggcgatgatgtgctggaagccgaaatgccggttgatacccgtactcatcagccgttcggtttactacatggcggcgcgtcggcggcgctggcggaaacgctgggatcgatggccggatttatgatgacccgcgacggacagtgtgtggtaggcacagaacttaatgcaacacaccatcgcccggtgtctgagggaaaggtacgcggcgtctgccagccgctgcatcttggtcggcaaaatcagagctgggaaatcgtcgttttcgatgaacaggggcggcgttgctgcacttgtcggctgggtacggcagttttgggatgaacccgacagaattagatgagattgcaggaaaactcggttaacggagtgatcgagttaacattgttaagttaaatattggtttcaactccgatttacatggttgctgtgttgttaaattgtacaaagatgttatagaaacaaaatgtaacatctctatggacacgcacacggataacaactatgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaagaaagtgctgttcggtcaccattttgcggccattgccggagcaggtccgctggtggggccggtactggcggcgcaaatgggctacctgccggggatgatctggctgctcgctggggtggttctcgccggtgcggtgcaggatttcatggtgctgtttgtttctacgcgccgtgacggtcgctcgctgggtgagctggtcaaagaagagatggggccaaccgccggggtgattgcgctggtggcctgctttatgatcatggtcattatccttgcagtgctggcgatgatcgtggtgaaagccctgactcatagcccgtggggaacatataccgttgcgttcaccattccgctggcgctgtttatggggatctacctgcgctatctgcgtccggggcgtattggcgaagtgtcggtcatcggtctggtattcctgattttcgccattatctctggcggctgggtggcagaaagtccgacctgggcaccgtactttgactttaccggcgtgcagttgacctggatgctggtgggttacggttttgtggcggcggtgctgccggtgtggttactgctggccccgcgtgactacctctctaccttcctgaaaatcgggactatcgtcggtctggcggtaggcattttgattatgcgcccgacgctgaccatgcctgcgctgaccaaatttgtcgatggcactggcccggtatggaccggtaacctgttcccgttcctgtttatcaccatcgcctgtggcgcggtgtctggcttccatgcgctgatctcttctgggaccacgccgaagatgctggcgaacgaagggcaggcgtgctttatcggctacggtgggatgttaatggaatccttcgtggcgattatggcgctggtttccgcctgtatcatcgatccgggcgtgtattttgccatgaacagcccgatggcggtgctggctccggcagggacggcggatgtggtcgcttctgccgcgcaggtggtgagtagctggggctttagcattacaccagatacgctaaaccagattgccagcgaagtgggtgaacagtcgatcatttcccgtgcgggcggtgcgccgacgctggcggtggggatggcctacattctgcacggcgcgctgggcggcatgatggatgtggcgttctggtatcacttcgccattttgtttgaagcactgtttattctgacggcggtggatgcaggtacgcgtgctgcgcgctttatgttgcaggatctgctgggcgtggtgtctcctggcctgaagcggaccgattcactgcctgctaacctgctggcaacagcgctgtgcgtactggcgtggggctacttcctccatcagggcgtggtcgatccgctgggcggcattaacactctgtggccgctgtttggtattgccaaccagatgctggcagggatggcgctgatgctctgtgccgtggtgttgttcaagatgaaacgtcaacgttacgcctgggtggcgctggtaccaacggcctggctgctgatttgtaccctgaccgcaggctggcagaaagcgtttagcccggatgcgaaagtcggcttcctggccattgctaataagttccaggcaatgatcgacagcggcaatattccgtcgcagtatactgagtcacagctggcgcaactggtgttcaacaaccgtctggatgccgggttaaccatcttctttatggtggtcgtggtggttctggcactgttctcgattaagacggcacttgcggcattgaaagatccgaagccaacggcgaaagaaacgccgtatgaaccaatgccggaaaatgtcgaggagatcgtggcgcaggcaaaaggcgcacactaaagtcagagtgagggggggatgttggcgaatgttggcttagtgcccagggttccctctcaccctaaccctctccccggtggggcgaggggactgaccgagcgcgttgatagcatttgtaggccggataaggcgttcacgccgcatccggcactctttcagcaacatggttagcggaggccaagatgtttgattcactggcaaaagccggaaaatatttaggtcaggcggcgaagctgatgattggtatgcctgattacgacaactatgtcgaacatatgcgggttaaccatcccgatcaaacgccgatgacctacgaagagtttttccgtgagcggcaggacgcgcgctacggtggaaaaggcggcgcgcgctgctgctaaatttgtacgtcaggctttaaacgattccacttttttgaacgctgcacgcaacgtatctggtgtcagcgtgactggcaggtaatgaatggactccaccggacgcagggtgtgggcaatcactttgtcgatctccgcctgattattgatatccacttccagctccgccagtgtagtcggcagatgaaaacgctgatacgctccagttaattgcgccagcacatcatcctgacccagcaaggcgctttgcaccagaattccgtaggcgactttggtgccgtggagaaacttctcggtttgcggcagcacggtcagaccgttatgcacggcatgagctgccgccacacgcgtaaaacgatcgcccagaccaccaaccatcccaccaccagcaataatagcatccaccacatcgcaaaatgattgcgttaactgttgattttgctgatcgctcagcgcctgttcgctactgtttaacaagacgtcgcgaatggcttgcgcattattgatccccagtcgcacggttagcggcaacgtttctggttgcggagccagcaccaccgcttcataccatttcgccagcgtgtcaccgatccccgccagcagatattgttgcggtgcattgaggataatctccggttccaccagcaccataaaattggcgtcgtcgaaaatctcataatgcagcgcctgtccggcatcattataccagacggagagcggtgtccaggcggcgcaggtggcggcgatcgtcggaacggcaacaaacggcagaccgagacggcgggcgagggctttcgcggtgtcgagcagtgcaccgccaccgacgccaatcaccacgctgcggtcgtcaccggactcagccgccagttgttgtacatcgctttcgctgcaatgaccgcgaaacaaaatatgctttgcccctggcagtccaaacgctggcggaagtttggtttgcgccgcagcaatggcgcgtttgccgtagatccacaccgcgcgagaaagttgttcatcagtgaaaaaatcgtgcaggtgattgaaacttcctggatgtgaaaagtagttagccgggccgacgaccacgcggataggattgtgaggcatgttgtgttgtccttattgttttatttagacatctaaacgtcttgattgccaaatactagcatcgtgttatagtgccttcaacacgcaacttcgtcaggtacaataaaaatgacaaataaccctctgattccacaaagcaaacttccacaacttggcaccactattttcacccagatgagcgcgctggcgcagcaacaccaggcgattaacctgtcgcaaggctttcctgattttgatggtccgcgctatttacaggagcggctggcgcaccacgttgcacagggggcaaaccaatacgcgcccatgaccggcgtgcaggccttgcgcgaggcgattgctcagaaaacggaacgtttgtatggctatcaaccagatgccgatagcgatatcaccgtaacggcaggggcgacggaagcgttatacgcggcgattaccgcactggtgcgcaatggcgatgaagtgatttgttttgatcccagctatgacagttacgcccccgccatcgcgctttctgggggaatagtgaagcgtatggcactgcaaccaccgcattttcgcgttgactggcaggaatttgccgcattattaagcgagcgcaccagactggtgatcctcaacactccgcataaccccagtgcaactgtctggcagcaggctgatttcgccgctttgtggcaggcgatcgccgggcacgagatttttgtcattagcgatgaagtctacgagcacatcaacttttcacaacagggccatgccagtgtgctggcgcatccgcagctgcgtgagcgggcagtggcggtttcttcatttggcaagacctatcatatgaccggctggaaagtgggttattgtgttgcgccagcgcccatcagcgccgaaattcgcaaggtacatcagtatctgaccttttcggtgaataccccggcacagctggcgcttgctgatatgctacgtgcagaacctgagcattatcttgcgttaccggacttttatcgccagaagcgcgatattctggtgaatgctttaaatgaaagccggctggagattttaccgtgtgaaggtacatactttttgctggtggattacagcgcggtttctaccctggatgatgttgagttttgccagtggctgacgcaggagcacggcgtagcggcgattccgctgtcggtgttttgcgccgatcccttcccacataaactgattcgtctctgttttgccaagaaggaatcgacgttgctggcagcagctgaacgcctgcgccagctttagctatttaaccgtccaggcgcgggaatattgacggtcggcaaacaactcttgcaggccgttaatttgcttcaggcgcagcacttcgtcgctgtccattcccagctctttgccaattttattatcgtcccatcccaactggctaagttcacggacgatttccgacatggcggtgatttgatggcgtccacgagcgcgattatgacgaatagtcgcggcgatgcgttgattacgcgtaccttccagacaggtcaccggcaaataaccttttaagcgtaattttaatgatgatgagcctttaccaatttcatggcggtgaaaaccatccacgatttccatggcatttttatccgtatgtgtgaccacaatgggttgggtaaaaccatctatttcaatggatttttgcagcagttttttttcgggtggtgccacgttgtttgggttgtaatcattaggcataagttggctgtttttaacccacagaacgcaatccactggctcttcacgaaaggggctaacctgatggatcgccatgcggatttcattaatcgctttgatgcgatcatcttccggcaagctggcgagaaattgcgttaaatcctgcgttaatcgttgttgcatagtatcccccattcctgacgttttccttttatccgttcgttataacgctgatagttcttcgattttgtggggctaaatgataatgcccgacaccagtaatcgttattgagtaaaactttgcatatccgccgccaggaggggatatctttcgcgccaatgtccccttgctgggtttgtggaacctcgatgccttttttctgataccagtgcaaataaatggcgattttattgcggtaatgctcagctgttttttccggcatgctattgagcagcaataatgcatattcttgccagtctaaatgttctggcttgaggattttccgatgcccatagaaatgattgtcatgtccggcgtaaatgccgccactttttaccccgctgactcgtgcgcacatagcagcccagcgatccggttcgataacgtgatagagccataatccttgtcgttgctccgggccaaaaggttcgcaaattcgcatatgacgcagaggaacgcctgcctgatacattaggttatacagtgggttgcagagactttgatgatttgcataccaggtccagatatcagccactttccagtcgtaaatggggtaaatgtaccagctatgaccgcctggtgcggccgtagtccagggtttatcgtcggcaaaacgttgtttatttaaactggcgatggcgacaaaacggttgtaggactcatccgcacggatgccgatcatcatcgccgccggacgtttttgtgaaaaccattcggcaaactcacgtacaaattgttcgaaggtcatgcctggctggtaaaagcagaaaaagtcagggtcggttatcgcatcttggggaggttgacgtacccattcgacatcaggttcccagcactgccattcgggttggtattgtgaaagggaattttgcgtcgtaagcgggagcgcaacccagtaaaactcttcgatgacatcggtgtacaactcgcgcagggactgaacatagttaatggtgcaagagaattgcgcctcccagtcgataaacaaaacgcagatttttttgcccatttgtcgggcaagttcggctgtcagatgcagcattaaaccagagtctttgccgccagaaaatgagacacaaacgcggggtagggtgttgagtgtccaggtaatacgctctcgtgcagcttccagaatattgagcggaagaggaattttataaatagacatctgaagacgctctctgaacgttacagggtgatcagtgagataagtctgttaattataaagtaaacactgtaaagcagagtgttttatttttcattcgcgctgtgaataaatagatgaaagttatagtagctgtctgtagttatatatcaaaaactctcatttagacggtcaataaatcgggagaacaccaaattatttaaagaagatttattataggaaatgtaaagctttattgaaggtaacggatgttctagttttatctcttttaagttaagaaagtcacggtaggaattataaagttcataggggactattcccagtaaatctgtaactgcaatgctattaatgattgtcagcaaagaggaaccacgaaatgagattttgcgattcataaatctctcgtctatttccatttgaatatcatcaacccctgctgatttagatattaattgggtgaactcttctgccataatttgttcataagtgctattgtcagtaattcgtggatgcctattactacaaattagagtattgcgaatcgtatgcaatggcatgcaaatgacggaacggctgatcactggcatttgggtgatcaccagatcggctttgcggtgaaccaacagttcttcagcattctctgctgacatgaggatatcatggcactcaatctcgacagaggaatcttgccgtaggcagcggatcagcatactattattagagcaagaaatgagctgagggccgtagataataaagtttttctttagttcggacttattgactatattaattgtttgttcaaggcctctgagatttttctcaagatggtgatgcagatttaaccctgttgtcgtcggcgcgataccttttcctgagcgaatgaataaagggtcattaaattgcgcacgtaagcgttgtaacgactggctcacggctgatggggtgatatatagtgattcagcagctttgctaatgcttaaatgctggtaaatacactcaaatatgacaagaagatttaagtcgaactttttcaagtcgtagagattggccatacactactccggttatatttttcttccatgatatattcacttaatcaatgttttttgcgtatatatttttattgattatgtttttttgcttaactcaggattaagtttttctaaaatagcacagccacttagggcagagcgagcaattcatgcttttttaggatggttgaaaagcagggatatagttcaaccatccatgaattaccttttatttattccccataatgatattaagcgttttctgatcgggcaaccccacggcctgttgtagcgtattttccttactcatgtaatagatagccggcgtgacatttgcccccagatcgtccatcagtttctcattgtcacttaacactttcatttgctctgtacttacgtttgcaggcacgtttagcttaagcttgccaccagaggcttcatattgttgccaggtttttgcgggatctttggaggcaagaattgccgctgctgtcgccgggctttctggcttgataaccccaaccaacaatgttcttaattgcactttgccagaatctacccacgggcgcgcctgctgccagaactgtttacaatatgggcagaacggatcggcgaagacgtagacaatgaccggcgcatcttttttaccgtcgaggagccagtgggattgttccatccgttgccacatttcgcgtccggctggtgcgtaaatttctttttcgataagtgtgttactcaggttttcacctttctcgttgtacatgtaaccagagatagcgtgcttaccatctggagtcaggtagatggtgacgcccatatcctgatactttccgagataacctttcattcctccgggggcatcgaatgttttgatgattgtaatgccctgtttttcaatcgcttttactggagcaggaagttcctctgcgaaggcgattgcaggaagcagagccagtaaaagtatcttttttaacattaatttgtccttttcagtcagtgcaaaagtcgagtaaaaggcataacctatcactgtcataggtaagagcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccactacgaagaactgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggccgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaaatttccttcgtctttcacgccatagcggcgttggcgtcgcccgctcaccccggtcacttacttgtgtaagctcccggggattcacaggctagccgccttgctctgacgcgaaatacttcggaaattcacctaattcttcgggtgctgcggcacccgattttcttccccgcaccatgatgcaagctgcatccaggtagccgcagaggccgcttgcatgatgatgtttaaagcccaggagataaacatgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccaggggccacgttttgcaggctccccgctgggccacgagttcacctcgctggtactggcgttgctgtggaccggtggtcatccgtcgaaagaagcgcagtctctgctggagcagattcgccatattgacggtgattttgaattcgaaacctattactcgctctcttgccacaactgcccggacgtggtgcaggcgctgaacctgatgagcgtactgaacccgcgcatcaagcacactgcaattgacggcggcaccttccagaacgaaatcaccgatcgcaacgtgatgggcgttccggcagtgttcgtaaacgggaaagagtttggtcagggccgcatgacgttgactgaaatcgttgccaaaattgatactggcgcggaaaaacgtgcggcagaagagctgaacaagcgtgatgcttatgacgtattaatcgtcggttccggcccggcgggtgcagcggcagcaatttactccgcacgtaaaggcatccgtaccggtctgatgggcgaacgttttggtggtcagatcctcgataccgttgatatcgaaaactacatttctgtaccgaagactgaagggcagaagctggcaggcgcactgaaagttcacgttgatgaatacgacgttgatgtgatcgacagccagagcgccagcaaactgatcccagcagcagttgaaggtggtctgcatcagattgaaacagcttctggcgcggtactgaaagcacgcagcattatcgtggcgaccggtgcaaaatggcgcaacatgaacgttccgggcgaagatcagtatcgcaccaaaggcgtgacctactgcccgcactgcgacggcccgctgtttaaaggtaaacgcgtagcggttatcggcggcggtaactccggcgtggaagcggcaattgacctggcgggtatcgttgagcacgtaacgctgctggaatttgcgccagaaatgaaagccgaccaggttctgcaggacaaactgcgcagcctgaaaaacgtcgacattattctgaatgcgcaaaccacggaagtgaaaggcgacggcagcaaagtcgttggtctggaatatcgagatcgtgtcagcggcgatattcacaacatcgaactggccggtattttcgtccagattggtctgctgccgaacaccaactggctcgaaggcgcagtcgaacgtaaccgcatgggcgagattatcattgatgcgaaatgcgaaaccaacgtgaaaggcgtgttcgcagcgggtgactgtacgacggttccgtacaagcagatcatcatcgccactggcgaaggtgccaaagcctctctgagtgcttttgactacctgattcgcaccaaaactgcataagaagaagtaagattcacctgcaattgcttagccgccggggtcaaacctggcggcttttttatggcattaaaaagccccgccgggatggctccgggcagggcgggatacttattctggcaattaacgcacaaccagcaccggcagattggcgtggcggatcacgctcgaggcgttagaacctaacagatgggtcgaaatcgatgggttgcgagaaccaataactacaacatcagcccccagttcttctgccaactcattgacttcatcccgcacgctaccaaaacggacatgttgtttaatgcgggaaggatcgatggtgaagtggctgaccatcgtttgcagacgttcttgtgcttcatgttgcagatgctcttcaaaacgacgcacatcagcggcaaaacggtgcaggctcaggctggctgacccgggtagtacgtgaagtagatgaataactccgtcatcctgggcgaggaattcagcgtggcgaacagctttgtcgctcaattccatttcaaatacatcaactggcataatgattgtcttatacataaccctttctccctgttaatcatgaacaaatcattcgccatgattataatatttatccctgatatttgtctggttctttttccttacgaactgtttctgtgatgaatatattctcactgaacaccaggaattctcccaaaacctgtggtaccgcccgttttcccgctgtgatagctacccttaaagactgactcttttttgaactgtctctggaggttgcatgaaagcattgacttatcacggcccacatcacgttcaggtagaaaatgttcccgatccgggcgttgaacaggcagatgatattattctgcgtattacggcaacggcgatctgtggctctgacctccatctttatcgaggcaaaatacctcaggttaaacatggcgatatttttggtcatgaatttatgggggaagtagttgaaaccggaaaggacgtaaaaaatttgcaaaaaggcgaccgagtggtaattccgttcgtcattgcttgtggcgactgttttttctgtcgattgcaacaatatgccgcctgcgaaaataccaatgcgggtaaaggcgctgcgctcaataaaaaacagataccagctccagcggcattgtttggttatagtcacctgtatggcggcgttcctggtgggcaggcggaatatgtccgcgtccctaaagggaatgtggggccgtttaaagtaccgcctttgctttcagatgataaagcgcttttcctttctgatattctgccaacggcatggcaggcagcaaaaaatgcgcagatccaacaaggttcaagcgttgcagtctatggtgctggtcctgtgggattgttgacaatcgcctgtgcacggttgctcggtgcggaacagatttttgttgttgatcatcatccctaccgcttgcatttcgccgccgaccgctacggcgcgatcccgattaattttgatgaagacagcgatccggcacagtcaattattgaacaaacggcaggtcaccggggcgtggatgcagtaatagacgccgtcggttttgaagcgaaaggcagcaccacggaaacggtgctgactaacctgaaactggagggcagcagcggtaaagcgttgcgtcagtgtattgcggcggtcaggcgtggcggcattgttagcgtaccgggcgtctacgctggatttattcacggtttcctgtttggcgacgcctttgataaagggttgtcgtttaaaatgggacagacccacgttcacgcatggctgggagaattattaccgttaattgagaaaggattactgaaaccagaagaaattgttacccactatatgccgtttgaagaggccgcccggggatatgagattttcgaaaaacgtgaagaggagtgccgtaaggtgattctggtacccggtgcacaaagcgcagaggcggcgcagaaggcggtttcaggtctggtgaatgcgatgccggggggaacaatatgatcgtcaggagtggttttcgaggtaaaggacagccatgacgataatcgccgccataatcagaaatcctatcaggatgtaaaatgcttctgccatggttattcccacaaacgaaacggaataattttgcagcaaaagtgaacagtgagaaccaggaaaaattgctgattttgcgtaaagaggatgcgagtgcatcctctgggcaaagcgagttatcgcttgtgcagatgggattaaagcaggtagtcgccagcagcttctggctggtattcgagttccagcacttcaaggtgggttgcaacgccgcccggaagttcccagtgaatggaatcgccaacgcgcagccccagcagtgcggcacctaccggagccataacggaaagctgagtattgctatcggtcatttttgccggatacaccagcgtgcgcacacgcacttcgccatcgctaagattgcggaatttaacccggctgttcattgtcaccacgtcgtgtggcatctcttctggcgaacacatttgggcgcgatccaactctgcgtttaacgcgtcggcgattggcaaaccagcataggcgggttgctccagcagaatatcgatgcgttcggcatccaggtcgttaatgatgatagttggtctggacatttttactccatgtcgtcggtgctgcgagtgtcgcagataaacatacccaaaagaaaaccctcaccgtcaggcggcgagggtttaactcacatgatgatactgactgttgctcactctttgaagtgatttgcgtcacattcagggaattcctcaatgcagcgcattatgtataaatcttaatcgccttggtttatggaagacgaattagcgtgttttgtaaatcagatgattaataacccgctttatcaatcacaaaggttttgccacagttacctgggtgaggttgtggcaagaatgagtttgcagaaagcggagcgttgatggcgtcagctttgatcgagatctgaatttcagtcaaatacgcagggttaccctggcacgttagcttaactgctttcacgttctcttttccccagcttttggcaaaggcggcgtcaaagtcacggcggctcactgttttaccgtaattatccgcaaggaattttccggcttcgctctctttaatttcttgattcaggcgtaccatcgtaccgaagtatgcgtccggatcaaaaccaaagcaggcaccgtgtttggcatattcgtagcgttccaggcaggaacgtccgccagctcctggcatgacttcacttagtttagcggccgtttccagtgataatccggtttccggcgatgaacacattcggctggcgcgcgcttctggtagattcgggattgggcgagtagcgcaaccgaagcgcatccagcggcgttcatcaacaccacgggcagcaaccgatttaggcaatcctggccacagaccatgtacggtcagaaaatcagctttgttggtcgtttcggtttgcaggcgacattcatctcgttcgttacgatttcgatcgtgttgactctggcaaaatccggtttgccaggagagggccaggacatagcgatcaaaatcgccatactgttttgcctgcaacgctaaggcgttggcagaagagaagggaagcagagaaaccgcgagcaacgcggcgttacgccagaatgctttcataatgggtgtggaactcatacatacactgaatactatctattaaatcataaaaaagcccgccaggtgggcttacctggcgggcgtgatgatttattcagcgtttggcgaacgtattagttccacatggcgagaatcggccagccaaccaacagcaacatagagatgtaaatcaccccgaagattgcgccaagacgccagtaatcttttgatttcacatagccacagccgtaaataatcaccccaggaccggttgcatacggcgtcagacagcccatgataccgatagacagcaccagcaggatacacagttgttccattggtacgcccggaatacctttaccgacggccagaataaccggcagcatggttgcggtgtgcgcagacaggctggcaaacaggtagtgtgcaaagtagaacaccagaaccagtacaatcaccgttgcgtttggtgagaatccttccaggtgcgtactcatggtaccggcgaaccagtcaataaaaccagaacgagtcaggccgttagccatcacaaccagagttgccaggttgaccagtgtgttccatgcgctgttatagcgggtaatgtctttccaaggcacaacgtgcagggccagcattagcgaaactgccagcagaccaaccgcagtagcattaatgacttcactgccaaatacccacaaacctaagctgagcaatacaaggccaatcagtgtccactctctgcgtgtcagcgcacccatggttttcagttcatcacccgcccaggttgccacttcttcactgtgtgtgatttccggtttgtacagcacgtaggaaagccacggcgcaatgataagcaagataaccccaaccggcaggaagcagaggaaccactgcaaccagctaatctggataccggcaattttgctgacgaactccagacccagcacgtttggtgccgcaccggtgacaaacatggacgaactcagactggtactaatgaccatcatccacatcaaatagccgccaatacgacgcgcggacggatcgttcgggaatgatttaaacaacggcggcaggtttttaatgaccggaaaaaccgtacccccggtacgcgcggtgttggaaggtgtaaacggtgccagcagaatgtcgataatgacaatcgcataacccaacgtcagcgtgcgtttgcccatgaatttcaccaggaaaagggcaatgcgacgacctaacccggaaacttcataccctaatgcaaaaataaatgcgccaaataccagccataccgtggtgctggaaaaaccagccaggccccatttcagcgcctgtttttgcgcattaaacgctgggtcagctaattctttggcatcaaagagcaggtaattactgccaataacgcaaatagtaaccgcaataaaactgatcgctgttgccggaattggctcgaggatcatgccgacaatcattgccacaaacacagcgaagtaatgccatgcctgcggcggcataccgtcggggacagggataagaaacatgacacccatcaccaccagtggggccaatagtttccatatattatcttttgctaaagacatacgggttctccgaaaattaatatttccaaatttatcaagtgcttaaataattaaatctgtgctaaaaaccaggtaaggatcagtaggtcagcactgccgcctggactgagatttcgttcgatacactccctgtcgaactgccggagataatcgagatcggcgggggttcgaatgccccctttttgcaataatgtttgcgcctcgcgctgtagccagcgcaggcccccctcgccaccgcgcgatgcaacgttggtatcgccgttgatcgccatcagtaggagcaaggtatcgagcaatgccagttcaggatctaacccctgatccagcagagtgaggtaatgcggcaaggcgtgattgatcaccagtggataacccgcttcggcttcaccgcgtgcgccggtaaggccaagctgttggtacaaccgttgacctgccgtcagttgtgaattattggtacgcagttcgcgatcggtcaggccacggcagaaacttgccgccgtagaacaaacggttgttggcgttaccggttggttgagttgaagcaaacggccaattgccgcacatagcagccctaaagaaaaaatgctgcctttatgcgtgtttacgcccgcagtggcgcggaacatatcaccttcgcaagccataccaattgggcgtaatccgtggagtaccgcttctggtgccatttccgcactacaggcaccaaattcaatgaaacggggtagccagccctgaatcgccagcgcgctgcggtggaaatcttccagcgccatatctttgtgcgcaccgcagttaatgcgatccacgaggcctggtttcggtgacagattgacttcagtcagcatggcgcgccagcccagcagggcgtactcatcgattaatgacgtcgcaagctttgtggttttagttgacgttgcaggcatcgacatcgttcagcagtgcctccatgcggttgagtaaatcggtcagttgatgggtttttccacgcgcgcagacggctgcgctttgttcgcacaacaggcagcggcgaggcggcagtgaatagtcgcggcgggagagaatttcgccttcgggcgtcaggacatcgatatcccataaccgcccgagaggatgactatgttcaagctcaatggtggcgagcttgaggtcgcgagccggggcggcaatgctcaacatgccctccggcccgctggcggaaaccagtgcagcctgctcctgaatttgccagccctgttttgcggctaaggcacgcaaggctgtcacgccatgattaaaaattcggcgtgtgacctcgctgtctttaatcggcccaggcgcaaccacggtaaaggagaccagtggaacaggatggcgcttgagccagacgtgttgccgtgcttgcctttcatcccggctgacgagcagctcgggaattgataccgcatggtggctggcgagttcaggaagcaggtgcatggcttattccttcacctgatgcacaacatcgatcaccgagccatcgcggtaacgcacaacggcaacgacgcggtctgtgaattcaatcggctgtggttcaccggtcagcagacgcgcacgttcgcgcagccactcaatggaaaccactttaatgcccgcttcctgcagacgttctgccagttccggacgtgccgggttaactgcgataccgtggtctgtgaccagaatatcgacactggagcctggggtgatgcaggtcagtacgttatccaccagagtcggaatacgaccgcgtaccagcggcgcgacgatgatggaaagcgcagaggcaatcgcggtatcgcagtgaccaccggaagcaccacgcagtacgccgtcagagccggtcagcacgttaacgttgaactgggtgtcaatttccagcgcgctcagtaccaccacgtcgagacgatcaaccgatgcgcctttcgaaccccagttagcgtactggttggcgctgatttcgatgtgattggggttacgggccagcgattgcgcagcatggctgtcaaagctctgcacatccagcagtttgcggatcagacctttttcgtgcaggtcaaccatcgtcgcggtaataccgccaagggcgaagtcggcgcgaatatcgcggctacgcattttgtcttccaggaaacgggttaccgccagcgatgcgccgccggtgccggtttgcatggagaaaccttctttgaagtagccagagttgacaatcacatccgcagcgctacgggcaataagcagttcgcgcgggttagtggtcatacgggtcgcgccagcgccgatttttgcagcatcgccaacgcggtcaactttgacgatcaaatcaacctgatcttgctcaatgcttgccggattatgcggataaggcagcagttcttcggtaagcatcacgacctgttttgcgttgtcggcatcaactattgcatagccgagggagccgcagcaggctttaccggtgtagccgttggcattaccgaattcatcacaggacgggacgccgaggaaagccacgtcgatattcagttcgccgctctgtaccagatgcacacgaccgccgtgagagtggatctgcaccggttctgccagcagaccacgggagatctcttccgccagtggaccacgcaggccggaggtataaatgcgggtaaccacgccctggcgaatgtgttctaccagcggcgcatggcaatcactcagggagctggacgccagggtcaggtttttaaagcccatcttcgcgatgacgtccatcaccatattgacggtcaggtcaccgccacggaaagcgtgatggaaggaaaccgtcatgccgtcctgtaaaccagagcgacgaatcgcttcttccaggttggcgcacagtttgcgatcgcgcgctttttcagcctggtaggtttgctttggcgagttctggaaagcggcaagatcgcattcagcgcgacgattccaggccgctacccgttcttgtcgttgagattgttcaattttctgcgtcattttgattgccttattcttcgcggatgccggaaagttctgcacgggagagcaccagacgggcgcgatcgataaccggaccgtccaccatcttgccgttcagggaaaccacgccgaggccttcgcgagcggcggcttcagcggcttctacgacgcggcgggcgtgatccacttctttctgggtcggtgcgtagaggttgtgcagcagatcaatctgacgcgggttgatcagcgatttgccgtcaaagcccagctgtttgatgtgggcggcttcttgcagaaatccggcttcgttgttagcgtcggaatagacggtatcgaacgcctgaatacccgcagagcgcgcggcctgcaaaatggaacagcgtgcgaacagcagttcagttccttccggggagcgttctgtacgcaggttgcgcacatagtcttctgcaccgagggcgataccgatcaaacgctcggaagcgtgagcgatttccactgcgcgggtaatccccagcggagattcaatcgccgccagcaggccggtgctgccgggttcacgaccacaggctttttcgatacgcaggatctctttttcaatatccagaacatcctgagcggtatcggttttcggcagacgcacaacgtccgcaccaccgcgaacgacggcttccaggtcgttaacaccccattcggaatccagcgcgttgacacgcacaatggtttcaatatcgcgatacagcggatgttgcagcgcgtggtaaaccatgcggcgggcggtgtctttttcacgcaatgctacggagtcttcgaggtcaaacatcagggcatcagccgggtagatgaaggagttgctgaccatcgcggcattggcaccaggcacaaacaacatgctgcggcgggtgcgagttttacgttgttgcagcgaagcggaaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacgtccagaatggtggtgcgaattgcatcgccaaactgtttctcaacgctgctattgatttgcaggtcgatatcctgcgtatcgagtggggcgatgcgtatcatcacatccccagactcaagggtgcctgcaacggcgggctggtttattttcatttttcacctgtttctcatgcgggggtcttttgacgagctgccgcgtcctggcgggagtgctcaagcaggttctgcaaataatgcagcgtgactgcagggaccagcggcgcgatagccgtgagatcgtttttcgccagcagttgacgtacccgggaagcggatatcggcatctcctggtaacgcagccgctcaatttcaaccagttcgatgggcggtgcggagatagtcggcgtttccagccagtagcgcatatcctggttgtactgggcggtaacgcgacaaaagggttcagtaccgacaaagcggtgagttacacccagcgcgggagcgaggtactgacggaaaatcttcagatcaatttcggtgtaacaatggttaatgacgctctgttctttaatgaagtagcaagggaacgtagcgcgggagatgatgtattcggagccacgatgcacagtcaggcgtggaatatcggcggtgccttttaacaccaaatccagccggtcttcataggggaagcgtgaagaatcttctttgactaaaaacagatgcaaccagtcgcactgtgccgcagcctgttgaatcagataacggtgaccattcgtaaagggattggcgttcatcacaatgcagccaatcttgttccctggatgacgaaattttttcagcgattcggcatagcgtttcagtcgcgtggcgctgttttccatcagcaccatcacgccgggtacgctggtcagcgtggaaaaaccgcactggcggaacagcgcctcgtattcggttttggtataaataaacagatgcgtgctgtgccgctcataggcgaggtttatcaattcagtggctaatgtcagcgccagtccttcaccgcggacggattcactgatagcaacgcatttaataatatttccggcaattccaccgcacgcgataagcttttcatcgcgggttacggtaataaatacttcgactgtggtgtcaacgctcaaatcattttcatgcaggaattgggcgatttccgccatttttttattttctgaacgttttacgcgggtgaaaatatcattgccgaacataataaatagtatcctgaaggtgcatgttgttatcgatttgcaacgaatgttgttcaatgttgcaaactgataaccttttattttcacttgggagaaagggggtgatcgaggtatatctttttctcctttcgctatacatcctaaggagtatttcggcgtgaaattttgatttatttcacatagagttagtggttttttatttatttaatgattttaagttttttaattaatgtaattacgaaatgactcgcaggtttaagtgatttaattgatttaatgaataaaatttgccacgatcataattaatatctatgtattttgattcaacattttaattacatccgtcaaagaggctcgggacaacccgcaaggaaaacaatgttgcagcttaacgagaataaacagtttgcatttttccaaagactggcatttccgctgcgtatctttttgctgattctggtgttctcaatatttgtcattgcagccctggcgcaatattttacggccagttttgaggactatttaacgcttcatgtacgcgacatggcaatgaatcaggcgaaaattattgcctccaatgacagtgtcatctctgcggtgaaaacgcgtgactacaaacggctggcgaccatcgctaacaaattacaaagagataccgattttgattatgtggtgattggggaccggcactcgatccgcctttaccatcctaatccggagaaaattggttatcctatgcagttcaccaaacagggcgcgctggagaaaggggagagctacttcattaccgggaaagggtcaatggggatggcgatgcgcgccaaaacgccaatctttgatgacgatggaaaagtcatcggcgtggtgtcgattggctacctggtgagtaaaatcgatagctggcgggctgagtttttattaccgatggcaggtgtgtttgtcgtgctgttagggattctgatgttgctgtcgtggttcctggccgcgcatatccgtcggcagatgatgggcatggagccaaagcaaatcgcacgcgtggtccgtcagcaagaggcgctgtttagttcggtttatgaagggctgattgcggtggatccgcatggttacattaccgccatcaatcgtaacgcaagaaagatgctggggctgagttcccccggacggcaatggttgggtaaacccattgttgaagtggtcaggcccgccgatttctttaccgaacagattgatgaaaaacgtcaggatgtggtggcgaactttaacggtctgagcgttattgccaaccgggaagctattcgttcaggtgatgatttgctgggggccattatcagctttcgtagtaaagacgaaatttccaccctcaatgcgcaactgacgcaaataaaacaatacgttgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgcgaggcgtttgccgatcgccaggtggcggggctgctttttggtaaagtgcagcgcgcccgggaactggggctaaaaatgatcattgtccccggtagccagctttcgcaactgccgccaggactggatagcaccgagtttgcagccattgtgggcaatttacttgataacgccttcgaagccagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggggtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttgaggacgaaacgccgctggcagagatgcatgcggaatatattcgtcacattcccggattcagtcagatattactggcgggaaatctggcgcaggcccgaatgatgatcgagcgttttaagccggggctaatcttgctcgataactatcttcctgacggtagagggattaatttactgcatgaactggtgcaggcgcattatcccggcgacgtggtgtttaccactgcagccagcgatatggaaacggtgtctgaagccgtacgttgtggtgtatttgattatctcattaagcccattgcctatgaacggctggggcaaacgctaacccgtttccgccagcgtaaacatatgctggaaagtattgatagcgccagccagaagcaaattgatgagatgtttaatgcttatgctcgcggtgaacctaaggacgagctaccgaccggcattgaccccttgacgctaaacgcggtgcgaaaactgtttaaagagcctggtgtgcaacatacggcagaaacggtggcgcaggcactgaccatcagccgcaccactgccaggcgttatcttgaatattgcgccagccgccatctgattattgctgaaattgttcacggcaaagttggcagaccacaacgcatataccacagtgggtgacatgataaagccggaggaaacttgcctccggcattactatttacttgcctgtgaccgctgctgccgttcctggcaccatcagctctgtagcaacgataacaatcaccaaaccaacaagcaccggtaccgaggtgcgttttacgacttcaaacggcgagatcttcgccatcccggcaaccgcaacgactacgccagaaacgggcgaaagggtacggccaaggtttgacgcctgcagcatcgggatagtcaaatacgccgggttaatgccggaagagtgcgccagtttcgggatcatctcaacaaacgcataaaacggcgcattgcctgaaccggtcgtgactgccgccagcattgtcagaatcaccaataccagcatcaggatgatactcgccgaaccaaacgaggtagcgatagaaatcagactttgaataaagccgatggtgctaagcccctgagcgaataccccagcggcaaccagcagcatcaccacgttagcaaacgcatctgccatcccgcgataagccacttccagaccagagaaaactttctgggtattaaagctgcggaggaactccagaatggaggcaatcagcatacaaatcaccagaatagtgatgatgtgtaattgcggaccccatttaccgtcaaaaatcagtacaccgatgatcggcgtgaacggcaaaatggcataaaacgcaggagcagtggtggtgatttcactgacatctaacatttcatgagagatgtgctcttttttatccagataacgttgccagaagaagtgggcgatcgccatgccgataattgcagcaattgagataggcagcgtcgttttgaaggcgaagtcaatcagcgacatttcggaagcttgcgccgccagcaccacatcccctgaagtcggtgcgagaataatcgccgccggggaggcacaaatggcagcagctgcgccacgactgataccaacgtttaccatcaccggaaatagggttgccatcagcaaaacacccagaccggttgcggaagagacggccagagacatcagacaggcgacaaaataggcggcaatcatcagcaggtaaggggagttaatatactgcaatggttttgacgccagcttgaccaccatatcattcgcgccgatatgggtcatgtaagcggcaaatccacacagcatcataatcatcatgccgaggtcgccgccgcggctcattagtaatattttaacgtattcaacgatatccgtggcgctgtagcctgttgaagcctggctggacggtaacactttgtgccccataatggcactgataatcagcaataacaggccaccgacaaataacacaccagtggcggaataccctttaatgatgtagcgagctacacccacaataaccacaaccccaataaggagctcaatgaatgtcagcataatttttcctgtctccaggccccaaagtaaataataaaaaattcctaaagcttaaggaaaaaatatgcccaataaattggcgatgaatgctgattaaaatcaagaaaaactgccattaagacattgaagttgctgtttttatacatagataacaaaacgcatatttagcggttggcaattatcacataataatgtgtgcaaattgatggtggattgatgcaaatttgttaattgcaatggtgttagctgcggctgtgcgctcaaaaaataatctaatatgagcataggttgacgatatatattatatacttcgttaagatgattgttgtatctcgttaaaaaataaaataatttttccttgattgcattttgtcatcaaaaaagacttggtttttcttttttgactattcccatcgcagaaaacgacgcatcatctttaatcgatgcgcggaaatatttaacttgaacaagcggaaataaatagagcagctattcagattattctttatgttgggtctattaaggttatgttaattgtagctttgctatgctagtagtagatttttgataaatgttttatggtcacaaatgaacgtgagtaaatatgtcgctatcttttcctttgtttttattcagttaatcagcgttggtaaagtttttgctaacgcagatgagtggatgacaacgtttagagaaaatattgcacaaacctggcaacagcctgaacattatgatttatatattcctgccatcacctggcatgcacgtttcgcttacgacaaagaaaaaaccgatcgctataacgagcgaccgtggggtggcggttttggcctgtcgcgttgggatgaaaaaggaaactggcatggcctgtatgccatggcatttaaggactcgtggaacaaatgggaaccgattgccggatacggatgggaaagtacctggcgaccgctggcggatgaaaattttcatttaggtctgggattcaccgctggcgtaacggcacgcgataactggaattacatccctctcccggttctactgccattggcctccgtgggttatggcccagtgacttttcagatgacctacattccgggtacctacaacaatggcaatgtgtactttgcctggatgcgctttcagttttgagacaaatgaagttttagtaacttctttaaaatcaatagctaaaataagtaacatcaaaaataacgcgacttttatcactttttagtaaagttacactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaagatacgtcagcaagaattcaaaacccgcttaatcagcgggttttttttggtctttagtgtgcggttgaggccgaaaacagccagaatgccagtgcggtcatggcaaaagaccccagaaggttgacgaaaacgttcagtaatgcccagccaaagcggccctcttgtaacaaaaacaccacttctgccgaaaatgttgagaaggttgttagaccgccacaaaatccggtggtgattaatactttccacactggatcaatgttcgtcatcctgctgaaccatgcgaatcctattcctatgatgaatgccccaatcaggtttgctgtcagcgtccccaacggaatcgcctgatgcagtgggttaaatcgcatacttaacagccatctcgccacgcttcccgtaccaccgccaataaaaactgctaaaagaagttgtaacactgcaaaatcctgctatttgatttgtatgagtgataagtgtaacgccgaataatcgtcgttggcgaattttacgactctgacaggaggtggcaatgctggttgccgcaggacagtttgctgttacatctgtgtgggaaaagaacgctgagatttgtgcctcgttgatggcgcaggcggcggaaaacgacgcatcgctgtttgccctgccggaagcattgctggcgcgcgatgatcatgatgcagatctatcggttaaatcagcacagctgctggaaggcgaattcctcggactttacggcgagaaagtaaacgtaacatgatgacgacaattctgacgattcatgttccttcaacgccggggcgcgcatggaatatgctggtggcacttcaggcaggaaacatcgtcgcccgttatgccaaactgcatctctatgatgcatttgccattcaggaatcacgccgtgttgatgctggtaatgaaatcgctccgttactggaggtggaagggatgaaggtcggtctgatgacctgttatgacttacgctttccagagctggcgctggcacaggcattacagggagctgaaatcctggtacttcctgccgcctgggttcgcgggccgctcaaagagcatcactggtcaacgttgcttgccgctcgtgcgctggataccacctgttatatggtggcggcgggggagtgcgggaacaaaaatatcggtcaaagccggattatagatccctttggcgtcaccattgcggcagcgtcagaaatgcctgcactcattatggcggaagtgacgcccgaacgtgtgcgtcaggtgcgcgcgcaactgcccgtcttaaacaaccgtcgctttgcgccgccgcaattattatgatgtttttttactcggcgcttgattcaccttgttacagattgctattgtgtgcgcgcgtcgaatgaccgttaatattctctggtttttaaggcgcgttctgttgccggttatatgtcaagaaggtatctatgggtgagattagtattaccaaactgctggtagttgcggcgctggtcgttctgctgtttgggactaagaagttacgtacgctgggcggagaccttggagcggccattaaagggttcaagaaggcgatgaatgatgacgatgctgcggcgaaaaaaggcgcagacgttgatcttcaggctgaaaagctctctcataaagagtgacgtggcgagcaggacgctccctcaatatcttgttcgatacaaaaaacccgcttcaaaaagcgggttttttatcagacagatgtaagtaattattacaggattacttaacttccatccctttcgcctgcaaatcggcgtggtaagaagagcggacaaacggaccgcatgcagcatgggtaaagcccatcgccagcgcttcggctttcatttcgtcgaactcatccgggctaacgtaacgttgaaccggcaggtgatggcggcttggctgcaaatattgccccagcgttaacatcgtcacaccatgacggcgcaggtcgcgcattacctcaataatttcttcattggtttcacccagtcccaccatcagaccagacttggtcgggatttccggatgcgcttctttaaagcgttccagcagcttcagcgaccagttgtaatctgcaccaggccgtacctgacggtaaatacgcggtacgttttccaggttatggttgaacacatctggtggcgttgcagtcagaatatccagagcacgatccatacgaccgcggaaatccggcaccagagtttcaattttgatttgcgggcttttttcccgaatggcagtaatgcaatccgcaaagtgctgggcaccgccatcgcgcaggtcatcacggtcaacggaggtgataaccacataacgcagcgccatatcggcaatggtctgcgccagtttcactggttcattggcatcaggagctaccgggcgaccgtgggcaacatcacagaacggacaacggcgggtacaaatagcgccgaggatcataaacgttgctgtgccgtggttgaagcattccgccaggttagggcaggaggcttcctcgcagacagaatgcaggccatttttgcgcattgcggctttgatgccctggatacgtgtagagtccgctggaagcttgattttcatccattccggcttgcgcagcagggcttcgcgctctgttgccacgtttttaaccgggataagggccatcttatcggcatcgcggtatttaacaccgcgttccatcacaatgggtttactcatagcgtgcgtgttccagttgcgaattacgaaggaaagcgtttcaattcaatagattgttgtaattatcaactatttttgaattaacgactggcagtatatcattgaaacggacctgaaagcagccaaagcggtcgcgaaaatgtaaaattgttgttggattgtgccattttatcgttctgcgctgtgatctggctgtaacaatactttttcaaaatgcattacggataacatctattactccgtgcaggatgggatcacgcaggctgaatttgttgtagtggatagagaaatctatttgctcctcatttaaggacggaaaaggcagtttttccagcggccagcagcggctaaacaggttataaaaacggctgggaataatcgctaacatgtcactgttggcaaccagtgcagcgattgtcaaaatgttgtagctggtgaaattgatttgccggtccggaaacatttcttgaactctctgccgcagaccgctgaaattttgctcttccggtaacagaagtacatgcgcagcgttgtcgatagtctctctgtcatcttctaaagagagtagtggatttccctcgcggcaaattaacaccatattgtcggtgaacagaacatgatgttgcaccgtacgattggtgcaaaacatgttatcgatgatgagatcggtttgaaactgactgagttggttttccgcgtcgctgatgggcgggttgcgcagtaaaagctgcggatagtgagttttaatcgcccgatagatgacaggaaggaccagtgctccgaccgagggagtggtcgcaatagttatcgttcgttgcttatcatagcttccttcgatatccagcgcgccaagaatggactcaaggccctgactgatatactcatgtagatgcatcgcaaatgcggtaggagtgacaccctggcctttgcgaataaacaatgggtcagggaatataacgcgcagtttctgaatagactgactgattgccgagggggtcagattaagcactttcgctgcattaacgatccctttatgtacatatacagcttcaaaaatagtcagaaggttaagatcaatatttcgtaaggttgtaaatatttgtggtttaccttctgacgactttctgcttaaacagggttcaatttgattattactatccacgcacttactccaattttattcatggaaaaataatatttaaaaaattacaataatcttatgtctaattggaacggaacgcttttgctcaccataatcaactatttcaataggttaatcaatggggtgagttacggagcaaggcgtggcaccgcatttctgcaagtgataaagaaaatatacaaacgcgaaggagatgtaaagcattagcagatattatgagtaatgacccagtgtaaattgggccattgatgtatggaattaagcggtaatatattcgaagtccggattgtttagtagcgctaaaatattttccagtaaacgtggagcaatattattagtcgtcgcttcgggtttccattgtgatattttagccatttccattccggcatacccacaaggattaatacgtaaaaatggtgaaagatccatattgacgtttaatgccagaccgtggaatgaacaaccgcgtcgaatacgtaaacccagtgagcaaattttcttttccccaacatagacacctggcgcgtcagcccgaggatgcgcttctatacccagttcagccagggtattcaccactgtttgctcaagcaaggtcaccagttcacgcacaccgagtttacggcgtttcaggttaagcaacacatacatcacctgttgccccggcccgtgataagtcacctgcccaccgcgatcgctctggatcaccggaatatcacccggcattaaaatgtgctccgcttttcctgcctgaccttgggtgaataccggatagtgctcgaccagccagatttcatcaagggtactatcatcgcgggtatcggtgaattcatgcatagcctgggagattggctcgtaaggctgaagaccgagctggcggacaagaattttatcctgatacaaaacggcatctccgtggagaatgagtaaaagtgggggaaaagtatatcacagcgaggagaggggagttacccgaccaggagccgggtaacggagaagcgagttacagaaccatgcggacaatatcgattttgcccagttcttcatacagtgtttcaacctgctcgatatgagtggcgttgatagtgatagataccgagtggtagttgcctttgctgcttggttttaccgttggggtgtagtcacctggcgcatggcgctgtaccacttcaaccacctgatcaaccagctcaggtaacgcctgccccataactttgtaagtaaaaggagtagggaattcaagcagttcgttaagtttggttttcatgtcagctccggcgtaacgtaattaaatagcaactcccgccagaaggcgggagttttttactgatgcttagtatatggggacggaaattacactttcaagtgtttaatttttaaccaaaccagtgatggaacattaatttaatgtaatcaatgattttgccgaagaagttaccttccgggatttcttgcaacacaaccagcgggcgttgctcgatcgttttgccatcaagctggaagttgatagttccgacgacctgattcttttgcagcggcgcatgcaattcactgctgttcagcacatagctggctttcagatctttcatgcgaccacgcggaatggtcaggtacacgtctttatcaacccctaacgaagcgcgatcagaatcaccaaaccaaaccggttcagaggcgaactctttacctactttcagtgggttaacggtttcaaagaaacggaagccccaggttagcagttttttactttcggcttcacggcctttaaaagtacgtccgcccattaccgcagaaatcaagcgcatctggccttcagtcgcagaagcaacaaggttgtaacctgctttgtcagtgtgtccggttttgatgccgtcgacattcaggctgttatcccataacaggccgttacggttcagctggcgaataccgttaaacgtaaattctttttctttatagatcgagtattcattcggtacgtcacggatcaatgcctggccgatcagcgccatatctcgcgcggagctgtactgaccatcagcatccagaccatgtaccgtctggaagtgggtatttttcaggcccagtgcgttaacgtagctgttcatcaagccaacaaaagcgtcctggctaccagcggcaaaatcggccatggcgacacaagcatcgttacccgattgcaggttaataccgcggatcagctgagaaaccggaacctgcatgcccggtttgaggaacatcagcgaagaacctttaaacaccgggttaccggtggcccatgcgtcgttgccgatagtgactaaatcagtttctttaaatttaccggctttcattgcctggccgataacgtaactggtcatcattttggtcaggctggcaggatcgcggcggacatctgcgttctgttcggcgagcactttgccggagttatagtcaatcaggatgtaggactccgcatcgatctgcggtacacccgggatcatagttttgatattcaggtcatcggcatgtgcagcagagataaaggctgtgcaaagagccgtggtgagcgccaggcgcttcatgatacgagcggaaaaaatggtattcatggtctgaactacgacatccgtgatggaattaaaaaagtgccctactatagcaaatgcactaccggcaggcatctgactttccgcgtgactttgttaacgtcatttacagaaattgacacatcagatgcctgctttacgctactgcgcggtagtaataaatgactgtaattgggcttcggtttgcaaacgttgctgcaaggtactggcttcggctttgctggcgaatgggccaagctggatccgccagaccgcgccattttgagttacgcgaccggggacgccgaacttctgtcccagttgctgttggtactgttgcgcacgagcctgatcgcttacggccccgacttgcaccataaagttgccgctggcgctttgcgagacggcttgcggtgtcaccattgcaggcgaggttgcaggcgttgtcgacggagctgtaacaacgggctgtggcgcaggcgtcggttcgctgccttccagtacaccaggcgctaaggtcgttggtgcgccgaggaaaccgctactggttaccggcgcgccggtcggatcttcgctttttagcgtcgaattactgaccggaagaatgtcaccctgcgggccagacactgaacttgttcccgcgccaccgcttaaatcgggaggtgcaggcagggcgtaagtctgtttggcgactgtggtacaagccataccaggaccagaaagcgaaccatcctgggcaacaataatcggatcgatacgaactttggtgttgtttgacgtgttaagacggtcagctgccgcgcgagaaagtgaaataacgcggtcgttgccgtaagggccgcgatcattaatgcgcaccacgatcattcgcccgttagccaggttagtgattctggcgtagctggggatcggaagcgttggatgggctgccgtcagctgtgtcggatcgaatgcttcgccagaggccgtcaggttactgccgggttcggcatcatagattgccgccagtcccgcctggctaaatcgagacggatcctgcacgattttgtagcttttaccgtcgcgctggtaatcctgatttgccgtcgcgttcagtggttcgaaacgcgggtccgccccgctaatttcaactatagggccgttacataccgcaggctgcggtacacttaccgtctgttgctgaccatcatcgcttgtacatgccgcgagcattcctgccgcgatgcagatcccgagccactgcttacgcattgcgcacctcttacacgcttttcgacaacattttcctgtgggtgtggattgacattacaatcccgaacccagccatcagcacaattagcgccgatcctccataactgaccagtgggagcggaacccctacaaccggcagaataccgcttaccataccaatatttacgaagacataaacgaataatatcagcattaagccgccagccatgacgcgaccaaaggtggtttgcgctctggcggctatccacagcccgcgcatgatcagcagaatgtagagagcgagcagaatcagaatgcccactaatcccagctcttccgccagtaccgcgaagataaagtcagtatggcgttcggggagaaattcaagctgtgactgagtgccgtgcagccagcctttgccgcgtaatccgccggagccaatagcaattttagactgaataatgtgatagcccgcgccgagtgggtctgattccgggtccaggagcatcattacgcgctggcgctggtaatcatgcatcaggaagaaccacagaatcggaatgaacgccgctaccagcactactgcgacgccaatcagacgccagctaaggccagagaggaacagtacaaacagaccggaaagcgcaacgaggattgatgttcccaggtcaggctgtgcagccaccagcagcgtgggcataaatatcagcaccagcgcgatgccagtgttcttcaacgatggcgggcaaacgtcgcggttgataaagcgcgcaaccatcagtggtacggctattttggcaatttccgacggctgaaaacgaacaataccgaggtccagccagcgttgagcacctttagagatggcaccgaaagcatctaccgccaccagcaaaataatacagatgatatagagatagggggcccagccttcataaacgcgtggaggaatttgcgccatcaccaccatgatgaccagacccatcgcgatttggccgattttacgctccatcatgccaatatcctgaccgctggcgctccagataaccagggcgctgtaaaccagcaatgccagtaagatcagcagcattgtgggatcgagatggactttatcccagaatgtttttttattcggattatccgtcatgattaatggtcctccgctgcggcaaccgctggattttccgcaggcagatcggtgttgttatcacccagcataatgtggtcgaggatctggcgcatcagtgtaccaaccgccggacccgcaccaccgttctccagaatcatggcgacagccacttgcggattgttgtatggcgcaaaggcggtcatcagtttgtggtcacgtaaacgctcggcaattttgtgcgcattataggtttcgttcgctttcagaccgaagacctgagcggtaccggatttcgccgcaattttgtacggtgcgctagcaaagtatttatgcgccgtaccgttagggcggttagcaacaccgtacataccgtctttcgccagctcccagtaaccggaatgaatatcgccgacgggcggttcatgcggctgtacccatggcacctgtttgccgtcttcggcggtgctcatcagcaaatgaggaaccttcacgataccgtcattaatcaggatcatcagtgccttactcatctggattggggtcgctgtccagtaaccctgaccgataccaaccggaatggtgtcaccctgataccacggttttttaaagcgtttctgtttccattcgcgggtaggcatgttgccggaacgttcttccgccaggtcgataccggtgtaatgaccataaccgaatttacccatccattcggagaggcgatcgatccccatatcgtaggccacctgatagaagaaggtatccgcagattcttccagcgatcttgtgacattcagacgcccgtggccccattttttccagtcacgataacgtttttccgaacctggcagttgccaccagcctgggtcaaacagcgtcgtattgcgcgtgatcaccccggcgctcaatgccgaaaccgccacatagggtttaactgtagacgcgggaggataaaccccctgtgtggcgcggttcaccagcggtgtattcggatcgttcaacaaggcggaataatctttgctggagataccgtcaacaaacaagtttgggtcataactaggcgtggaaaccagcgccagcaccccacctgtacgcggatcggtgactaccacagctgcgcggctacccgccagcagcgtttcaatatattgctggagtttgagatccagcgtcaggtaaatatcgtgtccggcttgcggtggtacttcttttaactggcgaataacacgcccacggttgttaacttcaacctcttcataaccggtctgaccgtgcagcacatcttcatagtaacgctcaatgcccagcttaccgatatcatgcgttgccgcatagttggccagtttgccgtcattattcaggcgttcgacgtctttatcgttgattttcgacacatagccgatgacgtgggtcaacgccgaaccgtaaggatagtaacgacgtttatagcctttaacttcgacacccggaaaacggtactgattgacggcaaagcgagctacttgtacttcggtcaggttagttttcaccggaatagaggtgaaacggtgtgaacgtgcgcgctcttttcggaatgcagcaatatcgtcatcggtcagatctaccacgctgcgcaaagcgtccagcgtttgctgcacgttatcgactttctccggcatcatttctatctggtagatagtgcggttgagggccagagggataccgttacgatcgtagataatgccgcggctgggcgcgataggcaccagcttaatgcggttttcattagagcgggtctggtagtcggtaaagcgaacaatttgcagattatacaggttggcgataagcacgccggtcagcagcaaaatccccaaaaaggcgaccagcgcccggcgcacaaacagcgcggactctgccgtatagtcgcgaaaagagttctgtagtttcatccgctgcgttttctactcaaagctcccttatcactcacggtgataaggatggttggtggtgatgctccacgcccggtacagactctctgcgaccagcacgcgaaccagcggatgggggagggtaagcgccgacagcgaccagctctgctcagccgccgctttacaggcaggcgacaacccttcaggcccgccaatcagtagactgacgtcgcgaccatccagcttccagcgttccagctcagcggctaactgcggcgtatcccagggcttgcctggaatatcgagggtgacaatgcggtttttgcctgcggccgccaacatctgctcaccctctttgtcgagtatgcgcttgatgtccgcattcttgccgcgttttccggccggaatttcaatcagctcgaagggcatatctttcggaaaacgacgcaggtactcggtaaaaccggtttgtacccagtccggcattttcgttcccacggcgacaagttgcagcttcacgcattaactccagagtttttccagttcatacaggcgacggctctcttcctgcatgacatggacaatcacatcgcccaaatccacgacaatccagtcggcgctgttttcaccttctacgccgagcggtaacaggcccgctgcgcgagactcctgcacaacgtggtcagcaatggacataacatgacggctggacgtacccgtacagatgatcatgcagtcggtgatgctggatttgccctgaacgtctaaggcgatgatgtcctgacctttgaggtcatcaattttgtcgataacaaaatcctggagtgctttaccctgcaagttttccccctgggtgaatcaaatagataaaaatggtctgtcagtatacctgaaccagaggcgatttcgggacaattgtcgccgaatcggctttcgaaagtgggctatcatcccaccccgcgccgcagattgcatcgccatttttgtaaaacaatttctacaaagtcgtgtctggcggaaaaagtctggctgcggagaatatcagcctgcccgggtctgtcaatggtcgttgcggcttacccgtaaaaaaacagaaaagtcatgcattctcgaccccgatggcacggctattgaggacgcgtagcgtcgcgaatttttggttgatatcaatggcgctccaacacccctggtcaacgcgaaaatgccacatagcttcggcaggcatgccaattaaacgggcgattaacagactcagtacaccctgatggctgacgactaaaatattctgatagtgctgaaattcactaagccttgcgataaagcgttccacacgttgcgaaaatgcctgaaatccttcaccgttcgtggggattgcatgctgccagtcattgcaccacgcgctatagttttcggcatcttcttgcatgaggtcgcgatgatgtcgcatctcccagtcgccaaaaaacatttcgttgagttcaggtatgatttgcacggggagctggcggtcactgagaaccagtcgcgcggtatgctgtgcccgttccagttcactgcataaaaccagatcaaaggaaacaccatgtagcagcgtatgcagattttgcgcttgctcaataccgcgcgcggtcaggggggtgggcgcatgaccgctgtaaagaccatcgatattcgcttgcgtttcaccatgacgaattaaccacagtcgcatcatgccctccgtaacgacaggtatcagcgatacaagccttgttggttaatgtaagtcagtaccggttccggcaataaatcctcacatgattcaccgttttgcaaacgttcgcggatgatggtcgccgagatgttaaaccacggcgtttcagccagataaattttaccggcaggctgaaggtgaagatcttccgggttatgtgtcaaatgatcttccagccattgctggtattgcggttgcgccatttcaagtgggtaacctggacgccgacagacgatcaaatgtgcattgtcgagtatcgtttcgtattcgtaccaggtcggaaaggtcagcagtgaatcctgaccaataataaacgccagcggcacgtccggtccttgttcctgccgccactctttcagtgtttgcgcagtgtaagagggggcattgcgctttagctcgcgttcatcaagagtaaataatggcttgtcggcaatcgccagttcaagcatgtgtttacgctgcacgctgttcgcttccggctggggacgatgcggaggaacattattagggatgattgtgacccgcgtcagaccaatcaaattcgccagcgtttccacgggttttagatgaccatagtgcaccggatcaaaggtgccgccaaacagagcctgtaaagatttcatatcaaccgtcgataaatacgtccgccaggggtttatggcacaacagaagagataacccttccagctctgcccacactgactgaccgtaatcttgtttgagggtgagttccgttcgtgtcaggagttgcacggcctgacgtaactgcgtctgacttaagcgatttaacgcctcgcccatcatgccccggcggttctgccatacccgatgcttatcaaacaacgcacgcagtggcgtatgggcagactggcgtttcaggttaaccagtaacaacagttcacgttgtaatgtgcgcaacaaaataaccggttcgctgccttccagacgcagttgctgaagaatatgcaatgcgcgcttactttttcccatcaacaaagcatcaacccaatgaaaaggggtgaaatgcgcggcatcattcaccgcctgttcaacgcgcggtaatgtcaatttgccgtctggccagagcagcgataaacgctccagtgcctgagccagcgccagcaggttaccttcataacagtagcagagcacctgatttgccgcgtcatccagttctaagttgagctgttttgcgcgcgcagcaacccagcggggaagctgagcctgctccggtgtctgacaggtcacctgcacgctgcgattcgcaagcgcagtaaaccaggcggcattttcttgcgctttgcttaatttattaccgcggacgatcaacagcaggtcgtcatgcagaagtccggtgagtgtgagaagttgctcattgatcgccgcattcggtccgttttctggtaacaacagcaatagcgtttgtcgactggcaaacagactcatagcctggcataacgaaaagatcgcattccagtcagtgttgggatcaatggaaaaagtgtggtgttcttcgaatccttgtgccgcagctacctgacgaacagcgtcctggctttcctgcaataacagaggatcgttaccaagtaaaagatacgccgcgcgcagcccttcattgagctgcgcgcggagttgttccgggtacaaccgaatcatcagttacccagcgtggtggagacgcgtgcaggcgttgccggagtatccgttgtggtcgacgtctgttcttcgtcggaacgaatatccgcagcacggatgcttggcagcttacgaatcagctgttcggcagcacggtcgtacatctcttttacgatcatgtcttgttcgttatctttcgctaacgccatttgcgggttatcgaagaacgaacggaagactttggcgctaatcgggtagatatcacggccggggatcaacacggtcgcattaaccgtcatgatcatctgatactctgctgtttgaccgttacggaataccgatgcggtatctttcgcgatgctcactttacccaaacgcaaggatggaacgtccttacgcgtggtttctttatcaagcaactcgacaccattcagacgtaactggttacgcaccgcacggcttaatggcccgttcggatcgcctgagtccaggatcatgaccttcatagtggaaggaacctgcgtggtatcacgcagatgccagccacacccggcggtgattaacaccgccagagataacaacaatgttgccagatatcgcacgcttcctcccgcgcttagccaacgaccagattgaggagtttacctggtacgtaaatcactttacgtacagtaacgccatcaagatattttgctaccagatgttcctggccagcacgttcgcgaacctgttcttccgttgcgtccaccggaacggtgattttggcacggactttaccgttaacctgcaccacgaccagcgtggagtcttccaccatcgctttttcgtcagcaaccggccacggcgcgttgtcgatatcgccttcgcctttcagttcctgccacagcgtgaagcagatgtgcggggtgaacgggttaagcatacggacaacggccagcagtgcttcctgcatcagagcgcgatcctgctcgccatcggttggtgctttcgccagtttgttcatcagctccataatcgccgcaattgcggtgttgaaggtctgacgacggccgatatcatcggtcactttagcgatcgttttatgcacatcgcgacgcagcgctttctgattttcagtcagcgcatcaacgttcagtgccgcaacatcaccttttgctgtgtgctcgtaaaccagtttccagacacgtttcaggaagcggttagccccttccacaccggattcctgccattcgagagtcatatcagccggagaagcaaacatcataaacagacgaacggtgtccgcgccgtaacgttcaaccatcacctgcgggtcgataccgttgttcttcgacttggacattttgctcatgccggtataaaccagttcatggcctgccgcatctttcgctttcacgatacggcctttctcgtcacgttcaacgatagcatcaaccggggaaacccagttacgttcgccgttttcgccaacatagtagaaggcatctgccagcaccataccctgacacagcaactgtttcgctggttcgtcagagttcaccatgcctgcatcacgcatcagtttgtggaagaagcggaagtagagcaggtgcataatggcgtgttcaataccaccaatgtagatatccaccggcagccagtagttagccgcttcggaatccagcataccttctttgtactgcgggcaagtgtagcgcgcatagtaccaggaggactccataaaggtgtcgaaagtgtcggtttcacgcagtgctggcataccgttaacggtagttttcgcccactccggatctgctttaatcgggctggtaatgccgtccattaccacatcttccggcaggatcaccggcagctggtcgtccggggtcggcattacggtaccgtcttccagcgtcaccatcggaatcggcgcgccccagtaacgctgacgggaaacaccccagtcgcgcaggcggtagttcactttacgctcgccaacgcccatcgcagtcagtttatcggcgatggcgttgaaggccgcttcatggtcaagaccgttgaactcgccagagttgaacagcacgcctttttcagtcagggcttgctgagaaagatctggctcagagccgtcagctgccaggataaccggtttgatgttcaggccgtatttagaggcaaactcgtagtcgcgctggtcgtgccccggtaccgccataactgcgcccgtgccgtactccatcaatacgaagtttgctgcccaaacgggaatttcttcgcccgttaatgggtgaaccgctttaaagccagtatcgacgccttttttctccatcgtcgccatttcagcttcggcaactttggtgttacggcattcgtcaataaaggccgccagttcaggattattttccgccgctttctgcgccagcggatgacccgcagctaccgccaggtaggtacaacccataaaggtgtccgggcgggtagtgtaaacggtcagcgtgttgtcatagtcgttaacgttgaaggtgatctccacgccttcggaacgaccgatccagttacgctgcatggttttaacggtgtctggccagtgatccagtttatccagatcgttgagcagctcgtcagcgtaagcagtgattttgataaaccactgcgggatctctttacgttcaactttggtatcgcagcgccagcagcagccgtcgataacttgttcgttcgccagtacggtctggtcgttcgggcaccagttgaccgcagaagtcttcttatataccaggccttttttatacagctcggtgaagaatttctgttcccaacggtagtattccggcgtacaggttgccagctcgcggctccagtcataaccaaagcccagcattttgagctggtttttcatatacgcgatgttgtcgtacgtccacggtgccggagcggtgttgtttttcaccgccgcgccttccgcaggcagaccaaacgcgtcccagccgatcggctgcaggacgtttttgcccagcatacgctggtagcgggcgatcacgtcaccgatggtgtagttacgtacgtggcccatgtgtagtcgaccagaaggatagggaagcatagacaggcagtaatacttctctttgctctcgtcttcggttacttcaaatgtgcgcttctcatcccaatgaagctgtactttggattctatctcttccgggcggtattgctcttgcatggcagccagtggtcctgttttcaatacggctacaaatgtagcgttgaggtggtttttcagatccgcatagcatagcccaaacgtccgcgtcaaaacagcctttcgcgcactcgacgttgaaatgatgcccggattattcatacattaatttacagagtttgtgggcgtattagcaaagcaaggaacaaagaacgtctattattatagtcagttaacgacccgggagatgaaacgatgaacaaggttgctcaatattaccgtgaactggttgcgtcactgagcgaacgcctgcgcaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagaatctgacagcgtctttatgcgggtgattaaagaaagcttgtggcaggagctggcagacatcaccgataaaacgcagcttgaatggcgcgaagttttccaggacctcaatcatcatggggtttatcacagcggagaagtggtcgggctgggaaatctggtctgcgagaaatgtcacttccatctcccgatctacacaccggaagtgctgacgctatgcccgaaatgtggtcatgaccagttccagagacgcccgtttgagccgtaatagtctgatttcgcacagcaataaagagaatatgggccgaatgaaattccccggcccttgtttttatctctacagtaaatcttcagtctcacgaatttcctgactgacatctctggttccggatgactgaactttacgatacaggtcgagagcctgtcggagatcgacaggtcttccttctccgtagtgatacataatggccaggttataccaggcagtggcgtcattgcattcagcggctttcgtaaaccattcaaaggcagcctgataatctttctcaacgccttgtccgtgtttatacatataaccgatgttgacgtaagcgccgacgctcccctgagcggcagccttcagataccagtacatcgcttgcttatagtcctggtccaccccttcgccagcgttataatcccatgcaatttgaaactgggcgtgccgattaccctgctgtgcgcttttcaaataccagaatgcggcgagtgtcttgttttgagcaacgccttttccgtcttcataaagatcggccagattgttttgcgcgtcactatggccttgtaatgcagcttgtttgtaccagaaaaatgccagcgcatagtcttttgcgactccgttgccatttctgtacatccacccaagattattttgcgcataagacattccgctctccgcggctatctgataccagacaaccgcttctttataattgggggcttctccacgatccagtgtccagccaagggcgttggaagcgaaagtatggccttgtagggcagcttttttcagccagaagatggcttgctcattatctttatgacggcttttatcctcggtatacttttgccctaaggaatactgtgcttcacaatgaccttgctcagcggccagcttcagccagtaaaaggctttttcgtcgtccggagaatcaattgcgctatcgcgattataataaaacccaacaatatattgagcctcgcaatcgcctttttcagcacgttcgataatctcatctattgataaattatcgcagcaacttgacgtgaaaatcattatcatttccttatggttgcagataaaacatattatatttttatgtgttccatttttgcgtaagccttattttatgcgtattatgtcgcgtcagaaaagtataaataaacgagcctcgcaatgcggctaatattcatttaatgaatatttaaggataaattatatggacatggagtcgcaaaaaatattgtttgcactttccactccgatggaaatacgcaatgaatgctgtttaccttcgcattcatcacccaaaatgtatttaggtacatgcttttttgacctttcttcctcatggggaattgatgaccgtgatgacctgctgcgcacaattcaccgaatgatcgataacggtcatgccgctcggttggcagggttttatcaccgctggtttcgttattcgccatgtgaatggcgtgactatcttgctgaactaaatgagcaaggtcaggcttatgcgcaatttgtcgccagcaccgccgaatgctgtggcgaagggggaatcaaagcctgggattatgtccggatgggttttttaagccgaatgggcgtacttaataactggttgagcgaagaagaaagtctatggatccagtcgcgcattcatctacgggctctacgttattatagtaactggcggcaatactttgccggttatacctttggtcggcaatattggcagtctcccgaagatgatcatctgcctttattacgcgaattcttagcgcgtaaagaatacgacgattccggcaatgatatgttttatcaattatttgccagtgatgatgcgtattaccctaccttgtcctggcaaccattggcttactattctgcatgcccggaaacgcttaaggatatgagcgacctatgaaaaattgctggaagatcctcgatatagaggaaacgactgacgtcgatattatccgccgcgcttatctggcgctgttaccgtcctttcatccagaaaccgatccgcagggttttaaacaacttcgtcaggcgtatgaggaggcgctacggattgcgcagtcgcctgctaaatctgtttggcaaccagaagaatatgaggtagcagaacatgaaattctgctcgcctttcgtgcgttacttgcctctgatagtgaacgttttctgccctccgcctggcagcgattcattcagcaattaaattattgctcgatggaggagattgatgaattacgctggtcgctgtgcacaatcgccatgaacactgcccatttatccttcgagtgcgtggtgttattagcagaaagattgcggtggttacaggaggaaaataccggggaaatagacgaagaagaactggaatcctttttatatgccattgcgaaggggaatgtttttaacttccagaccattctgcatctgcccgttgccgtgcaaaatgacaccatcgatttttaccaaatgttcgctcggatttggtcatcgcatccacaatggctgacattgtatttagcgcaacatcgcgcagtgattatccccgatgatgcaaaactgcacagaaatttactccgctggtatagcgcaggtcgcctggatatccccgaacttctggattacgcccagtcatggcgggaaactgaacctgataatgaagatgcgccttattatgaatacgcgcaacgcgtctattgtggagaaggcgaaagcctgttggcagaactttgtgactactggcgcgagtatccctccacccaggcggatgctttaatgttgcaatggtgccgtcagcatcgggtcgattattacccattactggtgatgatgattgaagcgcgtgatctggttaacgatcagggaaaaccgctactttatgtccccggcgacagcgcccgtacgcgttttcatttatacgaaatactcagcgatgaaaaactctctgcgctggggcgttcactggtcgagatggttttgcacaaaggacgtaagccgcggatctcactcacgcgtgatacagaacataccttatggccattatatctagttgccaaacaattagtgcaggcctgccaacctacagaagaatcattaatgccgattgtgagccgccttgatgcagaaaatcgttgtccactggaagcattaattattcgtcgattattaattcaggcggcgaattttaccgagaagcaaactgttgaaccggagccgcaaccgcagccaatgcccgttgacgatggtgggccaggctgtctgggcatcattaaaattattttctatatttttatctttgctggtttgatagggaaaatactccatctgttcgggtgacagtcgacgttaatgtgcgggaagcccggcaagtaatctttccgcatttttgtaatgttgtttggcggtcagttttaaccatttttgagattcataatggttaacattaatacctgagccatttctgtagatcaaacctaaagtatattgagcatgagcatacccttgttcagctgcttccttataccagagaattgctttacgggtgtcgggtttgacccccagacctttgaggtagatccaccccagtttactttgcgcgcgtggattttcctgttccgctgattgctcataccagtatctcgcctgtgtataatccagtggtttaccgtcgctaccatgaagataaaattctccaaggcgatattgcgacgttgagtgaccatgaatcgcggaaagctccgtggctgccgtggtgaatggaagactgcccggtgagcttaaataatcaaaggcataattcaccatggctttatcacgcaacgtcgttttcttgggttggctaatacaggtaattgctgcaactataaaaattgcgaatatatacattaattttttattcatgtgtgaatgcttcgattttctttttattttgaaagcgtcaagtttatactcatcaataataaaaaagtagtcagttaatgcacttaagggattattaacaaatgaataaggaagaacaatatcttctttttgcgctttctgcgcccatggaaatacttaatcagggttgcaaacccgcgcatgactcgccaaaaatgtatactgggataaaagaattcgagctctcatcatcctggggaataaataatcgtgatgatttaattcagactatttatcagatgactgatgatggtcatgccaatgatttagctggcttatatctgacatggcatcgctcttcccctgaagagtggaaagcattaattgctggtggctcggagagagggttgatttatacccaattcgttgcccaaaccgctatgtgctgtggggaagggggaatcaaagcctgggattatgttcgaatggggtttctgtcacgggtcggtgtgctcaacaagtggctgacggaagaagagagtttatggctgcaatcgcgcgtctatgtacgagctcaccattactatcacagctggatgcactatttttccgcctattcgttaggacgtctctactggcaatcttctcagtgcgaagacaacacttcgctacgcgaggcgctaaccctgtacaaatacgatagcgccgggagtcgtatgttcgaagagctggcagcgggaagcgatcgtttctatgccacgcttccctggcagccattaactgtccagtctgaatgcccggtaacgcttaaggatgtgagcgacctatgaaaacatgttggcaaatcctcgaaattgaaagcacgacgcaaatagacattatccgccaggcttatcttgctcgcttaccgttgtgtcatcccgaaaccgatccgcaagggtttaaagcattacgccaggcctatgaagaggccctgcgactggcggtaaatcctgtcgaggaagcagatgatgaagaaaaagatgctgccgctgaacatgaaatactacgtgcattcaggacattactggattcagaaagtgatcgttttcagccttccgcctggcagaaatttattcagcaattaaatacctggaacatggaggatgtcgatcaattacgctggccgctgtgtgcaatcgccatagaagcgcgatatctttcattaaattgtgcttctttgctggcagagcgtttgaactggcattcatttaatgacagcgaaggaatggatgaggaagaaagggaggcttttcttgaggccattcaggctggtgattgtttcgatttccttagccttctggaatatcccattgcgttgcagaaccagactgttgagtattacttcgcgctggaacgttgctgccgttaccatcctgactatgtcactgcgtttttggcgatggaaggtccgtggttaattcctgatgatgcaaagttacatcgcaaactgttgcgctggtacagctcggtgcaaacaggtatggcggaactcattcctgtcgctcaacagtggcaaacggaagaaccagaaagcgaagatgcccggtattacttgtgtgcacaacgtttgtactgcggcgagggggaaagcctgcttgccgatctctgcgcgtactgggaaagttacccatctacacaagctgataatttgttgttgcagtggagcaagcgtcattgcccggattatttcgcgttattagtgatggttatcgaagcgcggagcatggtagatgcgcaaggtcaaccgctgaaatatgttcctggtgagagcgcccggacgcggctgttatgggcggagattttacatagcggaaaattatcgccgttaggtcaatcgtttattgagtcgttattcttcaagcgcaaagcatgggcgtggtggaaatcgagagtcggtagcgagacagagcaagattcaccgttcctggatttgtatcgggtagcggaacaggtagtacttgaagcgtttccgaaacaagagatgctggcccgtcttaatacaaggctggaaggcggagatgctcatccattagaggccattgtcacccggatgcttttgacgaaagtgaaactcgagccggaggatgaagatgtcgatgagccaacacctgaaaatcatgaagaaaaaaatgatgagggtgaaaaaccacagagcattaccagcattatcaaaatcagtttaacggtgctggtgataggttatgctctcggcaaaatcgcgatgttgtttagctgacgatgtgttttttgcgccgatgccggatgcagcgtttacgccgcatccggcagccgtgtttatgggatctcaatggctaaataatcgctcgcccgccgccgaacttcatccacgcgggccatatcgtttgactgcaacgccgcatcaaaatcggtgatcacccggccgatctcttctcgctcgtcacccagcgcccgcgcccacaactcttccagtttggctttaaaggtgcgattgatgagcatatcgcgcggataaattttcaatgcggataaccgcgtccgactctcttcaatctgctgcgcgctcaatgttaccgggctgtggttaatcactctggacttaacgctgccgtcttccagaagcacgtcaacttcaagcaacccgttgatatcataactaaagcgaatatcaatcgactgataagccccggttttcttcaacggcacatcgaaggattccaccagaatgttgtttttaactttgtggttttctccctgatagacgttaaccgtaattgaatcctgttccgggtgcatggttgaataagtttctacacgcgacacgggcacagtggtgtttcgttcaataatcggcgagaaaatgccggaaacgccctggcggttaacttcaacgcccaacgagtaagggcaaatatcagtgaggattacctcttcaatatcttcactgcgtaagcggcaggcggcctggattgctgcgcccagcgcgacaatggtgctcggatcgtaactttgatacggtaatttgccaaacagacgcacggcgattcgctgcaccagcggcatttgtgacgcgccgccaaccagcaccagactgtcgatttgactcggcttcagacgcgcatcgcgcaacgcctgttcaatcggcactcgcaagcgattgagcagcggcaaccacaaatcttccagttcgttctcgtaaaattcgcattcccgcgtttcttcctgatactgccagcgaatgtgcaatggcgattgattgctacattttgccgcttccacacaggcgtacaaggctgccagttcactctcgttaagcgtggtcctggcgacatccgcgcgttttaaaacctcatcgaccagcatatgggtaaaatcttcgccaccaagaaagttgtcgccagcggaggcgtgaacttcaatcaccggcgtggcgtactcaagcaccgtaacgtcaaacgtgccgccaccgagatcaaacaccagcgaacgggtattttgttgggtatgcaggccatacgccatcgcagctgctgtgggttcattaattaagcgtaccgcatttaacccggctaactccgctgctaaacgggtatgcttgcgttgttcatcgctgaaataagccggaacggagatcaccacatctttaatcggacgttgcagaaattcttcggcatcttcttttaatgagcgtaataccaaagaggacagttctggcgcgttaaatgtgtcgctgcctaaccgccagttggtattactgcccattgcacgtttaaataacgctgccgttttatccggatgcgaagtacgccgtgatacagccggttttccgactaaaatatgattattttcatccatgctaattatggatggtgttaaatattcaccgaacttatttggaattaattgcgcggcaccgtctttccagacggcaattaaactattggtagtaccgagatcgataccaatggcgagttctgcattatccattgcatttatatcttgaaagaaaaagagataaacagattaagaccacccaggtaacgcgtggtgatcttaatcaatgacgtgtgttaagcgtaaaatttcagacgatcagccagtaaatcaacaaagccctgacgatcaacatcgaccattacggtggcattcggtttattgcctgtcagataataataatcaacaaccgtcataccctgggtatatttcccctgtgtttccacgccaacccagcgctcaacagaggtaaataactccggtttcaacagccaggcgatggtgcatgggtcatgcagtggtgcgccgacaaagccccatttttcgtctttatgatattcgaggaagaaatccagcagttcggcaacaatggttgaaacagggttaccaatcgcgcggaaacgctcggtgtcttcaacgtggatttgtgctttatgagtaacatccagaccggccatcaccaccgggatccctgactggaagacaatttctgccgcttccgggtcaacgtaaatattaaattcagccgcaggcgtccagttacccagccccatagcgccacccataatcacgatacgggcaattttgctatgcagttccggatggctattgagcagcaaggcaacgttagtttgcggtccggtagacacaatggtgacaggttccgcactttcacgcagcgttttcgccatcagctctaccgccgtacagttttgcggtgcgaatgtcggttccggtaatgccgggccgtcgagaccgctttcgccgtgcacattgtccgcgataatcaactcacgcattaacggttttaccgcgccgcctgctaccggaatatcggtgcgattaagcaaggtcagcatacgcagaacattgcgtaaggttttttctggtgtctggtttccggcggaagacgtaattgctttgacatcaagctctggtgaggcgagggcgagaactattgcgatagcgtcgtcatgacctgggtcgcaatctaacagaattggcagtgccattgttgctccttgttgtgtgcttctttgcgacaagggtaacgccaggatgtaacagatacgaggggcgaaacgataaagcgtgagatggcgcgcaattgggtatgcgcgccagagtgattaatgcaggattttcgcgaggaagtcttttgcgcggtccgatttcggatcatcgaagaaagcgtctttcggcgagtcttcgacaattttaccctcgtccataaagatcacccgattcgccactttacgggcaaagcccatttcgtgggtcaccaccatcatggtcattccttcgttcgccagttccaccatcacgtccagtacttcgttgatcatctccggatccagcgccgatgtcggttcgtcaaacagcatcgcaataggatccatacacaacgcgcgagcgattgccacacgctgctgctgaccgccggaaagctgcgccggaaacttattggcgtgagcagaaagcccgacacgctccagcagtttcagggctttttcacgagccggcgctttatcgcgtttaagcactttcacctgcgccagggtcaggttttcgataatcgacagatgagggaacagctcgaaatgctggaataccatcccgacgcgggaacgcagctttgccagatcggttttcttgtcgttaaccacgataccatcgacggtgatttcaccttgctgcaccggttcgaggccgttgacggttttaatcagcgttgatttgccggaaccagacgggccgcaaaccaccaccacttcgccttttttcacttcggttgagcagtcggtcagcacctgaaagtgaccataccattttgaaacatttttcagggtaatcattatgctgtccttcttttcaagtagctgaccaacaacgacgcgctaagactaataacgaaataaacaaatccggcaaacaggatcatctcaacctgcgtaccatcacgctcaccaatggttgaggcggtacggaagaaatcggccagggataacacatacaccagtgaggtatcctggaacagtacgatgccctgagtgagcagcagcggcaccatcgcgcggaacgcctgcggcagaataatcagtttcatcgactgccagtgagtcattcccaacgccagcgcggcgctcgattgaccacgagaaatactttgaataccagcacggataatctctgaatagtaggccgcttcaaacatcgaaaacgccaccatcgccgaaattaaacggatatcattttttggcgataatcccagcacgttttgcagaaaacccggcacgatcaggtaaaaccacagcaaaaccataactaaaggaatcgagcggaatacgttaacgtaggctttggcaaaccacgccacgggcgcaaagctggataaacgcatcaccgccagcatcgtgccccacaaaataccaatcactaccgccgtgacggtgattttcagggtgatcaccagcccgtcgagcagatatggcagggaagggacaatggaactccagtcaaactcgtacattatttgccccccatgttgccaggcaggcgaactttacgttcaaccagcgtcatcaccagcatgataaaagcgttaatcaacacatacgccagcgtaatggcggtaaacgactcccaggcatgggctgagtaatcgagcaatttacccgcctgcgccgccatatccaccagaccgatagtcgaggcgatggcggagtttttcaccaggttcatcatctctgaggtcatcggcgggacgataacgcgataagcattaggcagcagtacgtatcgataagcctgcggtagcgtcaggcccatcgccagcgcggcatttttttgccctcgcggcagcgactgaatcgcggcgcgtacctgttcgcaaacacgggcggcggtaaacagccccaggcagagcatggatgaaaggaaaaactgaatattgggatccagctcggccttaaaccacatgccgattttctccggcagcagctccgggatcaccagataccaggtaaagaattgcacaatcaacggcacgttgcggaacagttcgacatacaacgtacccagaccagagagaaaacggtttggaacggtacgtaaaatgccgaaaaatgaaccgacgaggaaagcgataatccaggcgcagatcgacaaagcgatcgtcacctgaaaaccactccagatccaaccaagataggtggtgttgccgaacggggcttgttgtaaaaaaataccccagttccagtctatagacataaatctactccagaaaaaagagggtagcagcgttaactgctaccctcgaagattgttacccagcgtattgcggttttcaggcccgatggggaacgaccatcaggcgtatagtctgtccgtgctacgtaacaatcgagagggctggaatttccgcccctggttcttgtaattagttcagtgccttgtcattcggttctttgaacagtgctttcatttcgtctgacagttcgaaattcatgttcaggtttttcggcggaattggatttttgaaccacttatcaaaccatttttccgcttcaccggaggtctgcacctgagcgatggtgtcatccatcagctttttgaactgcggatcatctttacgcaacatacaaccgtaggcctcctgagactgcggcttgccgacgatttcccagttgtctggtttcttcgctttcgcacgttcaccggccagcagagcgtcatccatcataaaggcaacggcacgaccgctttccagggtgcggaaagagtcaccgtgatctttggcgctgatgatgcgcatattcattttttgctcttcattcagtttgttgagcaaaacttcagaggtagtgccggaagtgacgactacggctttgtctttcaggttggcaaaatctttgatatcgccaccctttttggtcaacaggcgcgtaccgaccacgaaaatagtgtcagagaaagccgcctgtttttggcgttcgacgttgttggtggtagaaccacattcaaaatcgaaagtgccgttttgcagcagtggaatacggttttgtgaggtaatcggaatcagttttacctgcaagtccggtttgttgagtttctttttcactgcttcaacaatggcgttggagtaatcctgcgagtaacccaccactttttgctgattgtcgtaataagagaaaggcactgaagattcacggtgaccgacgacaatcacaccgtttttggcgattttgtccagagtactgcccgctgccggggcggcgtcatctgcctgtgccagtcctgcggaaagcgccagggcgaggattgctgtggcaggtttacgtaattgcatatccaactcctttatcttctgcgttaagaacgcatggatacccgttgtgagtgtttgtgttgttatcgtctgcaactttattgtgcagtgttgtgcctgttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaggtaacatttagtttggctaaatgtaaagatattgctgttttattgtttgtttttgcgagatgcgccgcaccattccgaagcaaaattcttaaaatgcactcttttagtgctaccgctggattactgtggtgcaactaggttgtactgatgctgtttcagggtttgccttgtataacaaagcaatagatgtgccaaagttggataggagaatattgttatccggataatgcactgatgccgcatccggtgagcgtgccgaaatatgggatgtattccggcacgataagaagggattatttacgtcgctgacgcagactcatcaacacagcagcaaaaccaaacaatgccgtcagcacccacagcggccagttgccggtacgtgcgtatggtgtgagtccggtggtcggcgtcacgttagtggttaacacctcgcgggtgaactgcgggatcatcgcctgaatctcaccctgcgggccaatcaccgccgtaatgccgttgttggtgctgcgcaacagtgggcgcgccagctccagcgcacgcattcgcgccatctggaagtgttgccatggaccaatagatttaccaaaccacgcatcgttggagatagtcagcagatagtcggtatccgggcggaagttatcgcgcacttgctcgccgagaatgatctcgtagcaaatagccgcagtaagctcaataccatttgccgacagcggcggctggatatatggcccacggctgaacgacgacatcggcagatcaaagaacggtgctaacggacgcagaatcgactccagcgggacaaactcgccaaacggcaccagatggtttttgttatagcgatcggctgattcgtagctgtacggcgcacctttacccagcgtgatgatggtgttgtaggtatcgtagcggttctgcttattgagacgcgcgtcgacaatcccggttaccagcgagctacctttatcacgcaactcaccgtccagtgctttgaggaacggttgctgattaatttccagatcggttatcgccgactccggccagataatcaacgatgatttgcccatcagcggtgccgttgcgttgtagtaaatcttcagcgtattaagaagctggccttcgtcccatttcagcgattgcggaatatcgccctgaaccatcgaaacctgaatggttttctccggttgtggggtaaaccactggatgtaacgcagcgggaagggaagggcaaacagcacgacggccaccaccagcggacgccagttgcgtttgaccaacgccagtgccagcaggccactaaccatcatcagcaggaagttaatggcttccacgcccattatcggtgccagcccttttaacgggccatcaatctggctatagccgaactgtaaccacgggaagccggtcagtacccaaccgcgcagaaactcggtcacttgccagagggcaggggcggcaatcgctacgcgcagccaggtggttttcggccacagacgcgacagcacgccagcaaacagtccggtatacagcgacaaatacgccgccagcagcaccaccaggaagatgttaaccgggccaggcattccgccaaaggtcgcgatgctgacatagacccagttaataccgctgccaaagaggccaaatccccagcaaaagccaatagcggcagactggagtggacggcggttaaaggtcaacgcctgaagccccatcagcgaaataatcgccgcaggccagacgtcgtaaggagagaaggccagcgttccgcaggcaccgaataataacgccagcagcaggcgaatgcgctggcgttcaattaatgaggcaaaagccatgtagttatctatccagtttcggttttattcatccagcttcggctggggtgagtcatccgggattttgacatgaacctgaataatacgccgactgtcggccatcgccactttgaactggtaaccgtcgatgtcgatagtttcgccacgcgccggaagatgcccaaatgcctgcatcaccagaccaccgatagtgtcgacttcttcatcgctaaagtgggtgccgaacgcttcgttgaagtcttcaatggaagccagtgcgcgtacggtccaggtatgacgactcagctgacggaagtcgatatcatcttcttcgtcatactcgtcttcaatctcaccaacaatcagttccaggatgtcttcaatggtcaccagaccggaaaccccaccgaattcgtcaataacgatcgccatgtggtaacgctgagagcgaaactctttcagcatccggtctacgcgcttactttcaggaacgacaaccgcctgacgtaacactttgtccatgctgaaggcttcagcatcgctgcgcataaacggcagcaagtctttcgccatcagaatcccttcaatgtgatctttgtcttcgctaatcaccgggaaacgtgagtgggcggactcgatgatgacatcaagacattcgtccagcgtctggttgcgtttcagggtaatcatctgggagcgggggatcatgatgtcgcgaacgcgttggtctgcgatgtccatcaccccttcgagcatatcgcgcgtatcttcgtcgataaggtcgttctgcccggaatcacggatcagcgccagcagttcgtcacggtttttcggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatcctcatagcccagagcaagcataatctctgtttcgagggcttccatttcttctgcttcgtcatcttcgatgtgatcgtaacctaacaaatgcagactgccgtgcaccaccatatgcgcccagtgcgcctccagtggtttgccttgctcctgagcttccttctcaaccacctgacggcagataaccagatcgcccagtagcgacatttccatgccaggcggcacttcaaacgggaaggagagcacgttggtcggcttatccttaccgcgataggtcagattcagactgtggctttcggcggtatcgaccacgcgaatcgtcacttccgattcttcctgaaactgcgggatcaccgcattcagccatgtctgaaactggctctcttccggtaacccggaattatcttcacatgccagttgtaaatcgaggatcacctgactcatttttgttcctgttcttcgcgcttgcgttctgctgccagcgccgcttttcgtttttgttcggcttcttcccaggcttcataggcgttaacgatacgcgccaccacagggtgacgaaccacgtcttcgctgtggaagaagttaaagctgatctcttcgacatcggccagcacttcgatggcgtgacgtaagcctgatttagtattacgcggcaggtcgatctgtgtgacgtcgccggtgataaccgcttttgagttaaaaccgatacgggtcaggaacatcttcatctgttcgatggtggtgttctggctctcatcgagaatgataaacgcgtcgttcagcgtacgaccacgcatataggccagcggtgcgacttcaataacgttgcgctcaatcagtttctcgactttctcaaagcccagcatttcaaacagcgcgtcgtacagcgggcgcagatacgggtctactttctggcttaaatcgccaggcaggaagcccagtttctcaccggcttctactgccggacgagtcagcagaatacggcgaatttcctgacgctccagggcatcaactgccgcagccactgccaggtaggttttacccgtacccgccgggccaacgccgaaggtaatgtcatggtcgagaatattggcgatgtactgcgcctggtttggcgtgcgcggcttaattacgccgcgtttggttttgatattgaccgctttgccgtactccggcacgctctccgcgctttgctccagtacccgcgcttctttaatcgcaaggtggatctgttccggttcgatatcctgaatctgaccgcgcatcggggcagtatcgacatacaggctacgcagaatgtctgccgcagcggtgacgcaaatcggacggccggtcagtttaaagtggttatcgcggcgattgatctcgatgccgagacggcgttcgagctgcttgatgttgtcatcaaacgggccgcacaggctcaacagacgcgcattgtctgctggctccagggtgatttcgcgagtgtctatgttcaaaccgttcctcttatctgtatgccgccggaagctgaacattcaccggcctataaggaaattattcacgccacaggaaaaaggcgcaagcattgcaataaagatggggataaagagagaaaaaacaaggcccaccggaacggcaggcctgagaattacggctgataataacccacgccaaggtcgttttctttgcgggtacgggcaatcactgattccggtgtttctgccacgcgcagacccatttcatcttcagtacgcaccactttaccgcgcagagagttcgggtagacgtcggtaatttctacatcgacgaatttaccgatcatatccggcgtgccttcgaagttgaccacgcggttattttccgtacgcccggaaagctccatgatgctcttacgcgatgtaccttctaccagaatacgctgggtggtgccgagcatccggcggctccacgccatcgcttgctgattaatgcgctcttgcagaatatacagacgctgcttcttctcttcttccggaacatcatcaaccatatcggcggctggtgtacccggacgtgcagagaagataaagctgtagctcatgtcgaaattgacgtcggcaatcagcttcatcgttttctcgaagtcttcggtggtttcgccagggaagccaacgatgaaatcagaactgatctgaatatctggacgcgccgcacgcagtttacggatgatcgctttgtactccagcgccgtatgggtacggcccatcaggttcagaatgcgatcggaaccgctctgtaccggcagatgcaggaagctcaccagctccggcgtgtcgcgatacacttcgatgatatcgtcggtgaattcgatcggatggctggtggtaaagcgaatacgatcgatcccgtcgatcgcagcaaccagacgcagcagatcggcaaacgatccggtggtgccgtcgtagttttcaccacgccaggcgttcacgttctgaccgagcaggttgacttcacgcacgccctgagccgcaagctgggcaatctcaaacagaatatcgtcggacggacggcttacctcttcaccacgggtgtaaggcaccacgcagtaggtgcaatatttattgcagccttccatgatggagacaaacgcggtcggcccttcggcgcgcggttccggtagacggtcaaacttctcgatttccgggaagctgatatctacaaccgggctgcggtcgccacgcacggagttgatcatctccggcagacggtgcagcgtttgcggcccaaaaataatatcgacatagtgggcgcgctggcgaatgtgctcgccttcttgcgatgccacgcagccaccgacgccgataatcaggtctggattcttctcttttaacagtttccagcgacccaactgatggaagactttttcctgagccttctcgcggattgagcaggtgttcagcagcagcacatccgcttcttccgccacgtcggtcagttgatagccgtgggtggcatccagcagatcggccatcttcgatgaatcgtactcgttcatctgacagccccaggttttaatatggagttttttggtcatcgacttgctcttgcgaaatagtagccaggaatgcagggcgcatagtgtaatgctttgctgccgttgtgaccagtatgagcgttatcagcccttaggggtaaaaatcctgtaaacttaaagcatattgctaacaggatgattgaccatgacaaatcaaccaacggaaattgccattgtcggcggaggaatggtcggcggcgcactggcgctggggctggcacagcacggatttgcggtaacggtgatcgagcacgcagaaccagcgccgtttgtcgctgatagccaaccggacgtgcggatctcggcgatcagcgcggcttcggtatcattgcttaaagggttaggggtctgggatgcagtacaggctatgcgttgccatccttaccgcagactggaaacgtgggagtgggaaacggcgcatgtggtgtttgacgccgctgaacttaagctaccgctgcttggctatatggtggaaaacactgtcctgcaacaggcgttgtggcaggcgctggaagcgcatccgaaagtaacgttacgtgtgccaggctcgctgattgcgctgcatcgccatgatgatcttcaggagctggagctgaaaggcggtgaagtgattcgcgcgaagctggtgattggtgccgacggcgcaaattcgcaggtgcggcagatggcgggaattggcgttcatgcatggcagtatgcgcagtcgtgcatgttgattagcgtccagtgcgagaacgatcccggcgacagcacctggcagcaatttactccggacggaccgcgtgcgtttctgccgttgtttgataactgggcatcgctggtgtggtatgactctccggcgcgtattcgccagttgcagaatatgaatatggcacagctccaggcggaaatcgcgaagcatttcccgtcgcgtctgggttacgttacaccgcttgccgctggtgcgtttccgctgacgcgtcgccatgcgttgcagtacgtgcagccagggcttgcgctggtgggcgatgccgcgcataccatccatccgctggcggggcagggagtgaatcttggttatcgtgatgtcgatgccctgattgatgttctggtcaacgcccgcagctacggcgaagcgtgggccagttatcctgtcctcaagcgttaccagatgcggcgcatggcggataacttcattatgcaaagcggtatggatctgttttatgccggattcagcaataatctgccaccactgcgttttatgcgtaatctcgggttaatggcggcggagcgtgctggcgtgttgaaacgtcaggcgctgaaatatgcgttagggttgtagccttacaacattgccggatgcgtgccaaccgtaggtcggataagacgcggcagcgtcgcatccgacattgaaggataagacgtgtcaacatcgcattcgacattgaatgaacgcagaaaagcaaaaagctcgccgaagcgagcttttttaatgtggctggggtacgaggattcgaacctcggaatgccggaatcagaatccggtgccttaccgcttggcgataccccaactgggtgcacttacaaggtaagcgtcttgaataaattggctggggtacgaggattcgaacctcggaatgccggaatcagaatccggtgccttaccgcttggcgataccccaacaaattggttttgaatttgccgaacatattcgatacattcagaatttggtggctacgacgggattcgaacctgtgaccccatcattatgagtgatgtgctctaaccaactgagctacgtagccagattgtttcttcgatggctggggtacctggattcgaaccagggaatgccggtatcaaaaaccggtgccttaccgcttggcgataccccaataaccgggcggtgaaccgcttactcgaagaagatggctggggtacctggattcgaaccagggaatgccggtatcaaaaaccggtgccttaccgcttggcgataccccatccgtacaacgctttctggtgaatggtgcgggaggcgagacttgaactcgcacaccttgcggcgccagaacctaaatctggtgcgtctaccaatttcgccactcccgcaaaaaaagatggtggctacgacgggattcgaacctgtgaccccatcattatgagtgatgtgctctaaccaactgagctacgtagccatcttttttttcgcgataccttatcggcgttgcggggcgcattatgcgtatagagccttgcagcgtcaacctctttttcaaggaaaattgctcgaaagtgactgtttggttaggttgcgaacagcgtggcgctatattcgtcaattattgtttactttgtgttttttcccaccctacagccattcttttgtcatacaggatgaaattcggaatttaacaatagtggtgggaaattaatctatgaaatactggcctacagtgatgagttgtcaaacagtgatgtggcaaacccggaacatttccttactgcatatcagaatcaacaagcacctcaataactgaaacagccccggatttcaccggggctgtttcgcatttcttacttatacgccgactggtgaacaccaaccgcgcgaccagacggatcgtccattttcttgaacgcttcatcccattcgatcgctttagcggaagaacaagcgacggaaggaccgcccggcacgcactcagcggcgctcggaagcgggaatagttcttcaaagatctcccgatacaagtacgcttctttagaggttggcgtgttgtacgggaagcggaagcgggcagtttccagttgctgatcagaaacctgctgcgcagccacttctttcagggtgtcgatccaactgtaaccgacgccatcggagaactgctctttctgccgccaggccacgcttgcaggcagatacgcttcaaaacattcacgcaggatgtgtttttccattttgccgttaccgcacattttatcctgtgggttaatacgcatcgccacatcaaggaattttttgtcgaggaacggaacgcgtgcttccacgccccaggctgacatcgctttgttggcacgcgcgcagtcatacatatgcagggccagcagtttacgcaccgtctcttcatgcagttctttggcattcggtgctttgtggaagtaaagataaccgccgaacacttcatcagaaccttcaccggacagcaccattttaatgcccatcgccttgatcttacgcgacattaaatacatcggtgttgaagcgcgaatagtggtcacatcataagtttcgatgtggtaaatcacgtcgcggatggcatccagaccttcctgtacagtgaagtgaatttcgtgatgcaccgtgcccagatggtttgccacttcctgggctgctttcagatccggtgaacccggcagacctacagcaaaggagtgtaactgcggccaccaggcttcagagcgttcctgatcttccacgcgacgggctgcgtatttcttggtgatagcggaaataattgaggaatccagaccaccagaaagcagcacaccgtaaggcacatcagacatcagatggcttttaactgaatcttccagtgcctgacgcagctcgtttttgtcggtcacgttatctttcaccgcatcgtagtcgaaccagtcgcgatgatagtaagaacggatttcgccgtcctggctccacaaatagctccccgccgggaactctttaatcgtgcggcaaactggcaccagcgctttcatttctgaggccacatacagctgaccgtgttcgtcataccccatatacagtgggatgatccccagatggtcgcgaccaatcaggtaggcatctttttcgctgtcgtacagtgcaaaggcaaacatgccctgcaagtcgtcgagaaattccggccctttttcctgatacagcgcgaggatcacttcacagtcagacccggtctggaactggtaacgatcgccatattcggcgcgcaatgcctggtggttgtagatttcaccgtttaccgccagtacgtgggttttttgttggttgtagagaggttgcgcccccgcgttaacgtcaacaattgacagacgttcgtgggcgagaatggcgttatcgctggcataaataccggaccagtccgggccacgatgacgcatcaggcgtgacagctcgagggctttcttacgcagctcaactgcgtctgttttgatatcgaatacgccaaaaattgaacacataaccttctccgttaacctggtatttgttgcttgttgtgtttgcttgtttaaaaaaatgccgcaaagcagcactgtgcgcaagcgatttggcggtgaaaaaataaaaaacgtaatggtgattgtcgattggtgaaaaaaggtctggtgtgaggatatatttattgatgaatcgataatttttagcgggttttattgaatgtttatattttacgggggccaaattgctgacaaagtgcgatttgttcatgccggatgcggcgtgaacgccttatccggcctacaaaagcatgaaaattcaatatattgcaggagctgcgtaggcctgataagcgtagcgcatcaggcagtttggcgtttgtcatcagagccaaccacgtccgcagacgtggttgctattcagataacgtcgatttcagcgactgacgggtaaatccagctggggcggaaaggcatactgtcgatatcgtcgagcgacgaaacaccagaaagcaccagaatcgtctccagacctgcctggaagccggccagaatatcggtacgcaggttatcgccgacaatcaccgtttcttccgaatgcgcctgcattttgtttaatgctgcgcggatgatccacgggctgggcttaccaacatagaacggtttgcgcccggagattttctcaatccctgcacacaacgcgccacaagcgggataaaaaccgcgcccgtgggtgtccggattggtggcgataaaacgtgcaccgttagcgacgaaataggctgctttatgcatcatgtcccagttgtaggaacgcgtttcgccaacaatcacgaaatcagggttcacatcggtaatagtgaaaccggctttgtacagttcatgaatcagtgcgccttcgcccaccacatacgctttcttgccttcctggcgacgcaggaaatcggcagtcgccatcgcagaggtataaaacacgctgtcaggtacatcgacacctgcggtggcaaagcggttcgccagatcttgcccagtctgcgaaggatagttggtcagcaacaccagcggcaggcctttatccataatcccgtgcaaaaattccgctgcacccggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccagctcagaacgtaccaccggcagattagtgcgaaacgccttcagcgcctgggtattaatgcagctttcaatagcagggagcagcactttatcggcttcggtgatttcaccggcaataacaattttttgcggattaaataagttgatagcaatggcgatggttttacccagatgacgaccgacatactcaattacttccgacgccagactatcgcctttgttcgcggctttgcagatagttttgatggtgcagtcgtccagcggcacgcggctctggtagccctgctttaacagattcaacacccgttgttcaatggcagcgttggcagcgatagtttccaggcagccaaagttgccgcagtggcagcgttcacccagcggttcgacctgaatatggccaatttcaccgacgttgccgttgcggccaataaaaatgcgcccgttagagataatcccggccccggttccgcgatggacacgcaccagaatggagtcttcgcaatcctgacttgcaccgaagtagtgctccgccagcgccagactacggatatcgtgaccaacgaaacaggtcactttaaaacgttcttccagagcttctaccagcccccagttttctacctgaatatgcggcatgtaatgaattttgccgctgtccgggtcaacaagccctggcaggatcaccgaaatcgcgatcagctcgcgcagtttgcgctggtagctatcaataaactgagcaatggcattcaacagggcatgttccagcgtttgctgggtacgttccggcagcgggtaatgttcttctgccagcactttgctgctgagatcaaacagagtgatggtggcgtcatgacgaccaagccgtacgccgattgcgtggaaattgcgggtttcggtgacgatggagatagcgcggcggcccccggtggaggcctgctgatcaacttctttgatcagcccgcgttcgataagctgacgcgtaattttggttacgctggcgggggcaagctggctttgctcggcaatctgaatccgcgagattggcccgtactggtcaatcaggcgataaaccgccgcgctgttaagctgttttacgagatcaacattacctatctgagcttgtccgcctggtgtcatactttctcttattgagttacgacctcgttaccgttaacgatggtcttggtgattttaaaatcaggtgtgaatgcagtcaggttggctactttacctgcggcgagtgtgccgagacgtttctcaacgccaatcgcacgcgccggatagagcgtcgccatacgtagcacttcatccagtgcgataccgcaatgttcgaccagattacgcacgccttcaatcatggttaaggatgaaccgcttaacgtaccgttctcatccacacaaagtccgttacggtagtatattgttttacccgcaaaaatgaactgttcaatgttggcacctgctggcgcggtggcgtcagtaaccagacacagtttgtcgcctttcagacgtttagcgttgcgaatgttggcgtaatcaacatgcaggccatcagcaataataccgcaataaatgtcagcttcgtcgaggatcgcgcccgccaggccaggttcacgaccggtaatatacggcatcgcgttgtacagatgggtggcaaaggtaatccccgcgcggaaaccggcttttgcttctttcaacgtcgcgttggagtgaccggcagaaaccacaatcccggcatttgccagtttgctgatgacttccgcaggaaccatttccggtgccagggtcactttggtaatgacgtcggcgttttcacacaggaaatcgaccagcgcggcatcaggcttacgcacaaaattcggattatgggtgcctttttttaccagattcagccacggaccttccagatgcagacctaacgcctgattcggatgttttgccaggtactcgcgcataacgcgcacgccctgtttcatcagctcatcgctggtggtgataagcgtcggcagatagttagtacagcctgatttctcattggctttctgcatgatttccagcgtttccacgctgaccgcttcagcggtgtcgttaaactgtacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattttaaaaaatattgccctgagcaaggagccagggcagggataacaattacagacctttgatattttctgcttctaattcattgaaatatcttaaagtcttaactttcagctccatggtggaaggttcatcgcacaccatgatcgctttcggatgcagttgcagacagctgatggtccacatatggttcacgcaaccttcaacggcggcctgcagcgccagtgctttctggctacccagcaccagaatcatcacttcttcggcatccagcagtgtaccaacaccgacagtcagggcatattttggcacctgattaacatcgttatcaaagaaacgagagtttgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcactcggcgtcgatatccggggcgttgccgttgagaaggttgatgttttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcatcggcgtgccgccagtcggcaggcccagtacaaacggacgatcggcagtcggtttgaacgcattgatacgattgacgatatggcgagcagcccatttgccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatgataaaataagttttctggtttagccagtaaaagggagtgataataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggcttgaaacgagccaaatagggttctcgtagggggaataagatgaatattttaggttttttccagcgactcggtagggcgttacagctccctatcgcggtgctgccggtggcggcactgttgctgcgattcggtcagccagatttacttaacgttgcgtttattgcccaggcgggcggtgcgatttttgataacctcgcattaatcttcgccatcggtgtggcatccagctggtcgaaagacagcgctggtgcggcggcgctggcgggtgcggtaggttactttgtgttaaccaaagcgatggtgaccatcaacccagaaattaacatgggtgtactggcgggtatcattaccggtctggttggtggcgcagcctataaccgttggtccgatattaaactgccggacttcctgagcttcttcggcggcaaacgctttgtgccgattgccaccggattcttctgcctggtgctggcggccatttttggttacgtctggccgccggtacagcacgctatccatgcaggcggcgagtggatcgtttctgcgggcgcgctgggttccggtatctttggtttcatcaaccgtctgctgatcccaaccggtctgcatcaggtactgaacaccatcgcctggttccagattggtgaattcaccaacgcggcgggtacggttttccacggtgacattaaccgcttctatgccggtgacggcaccgcggggatgttcatgtccggcttcttcccgatcatgatgttcggtctgccgggtgcggcgctggcgatgtacttcgcagcaccgaaagagcgtcgtccgatggttggcggtatgctgctttctgttgctgttactgcgttcctgaccggtgtgactgagccgctggaattcctgttcatgttccttgctccgctgctgtacctcctgcacgcactgctgaccggtatcagcctgtttgtggcaacgctgctgggtatccacgcgggcttctctttctctgcgggggctatcgactacgcgttgatgtataacctgccggccgccagccagaacgtctggatgctgctggtgatgggcgttatcttcttcgctatctacttcgtggtgttcagtttggttatccgcatgttcaacctgaaaacgccgggtcgtgaagataaagaagacgagatcgttactgaagaagccaacagcaacactgaagaaggtctgactcaactggcaaccaactatattgctgcggttggcggcactgacaacctgaaagcgattgacgcctgtatcacccgtctgcgccttacagtggctgactctgcccgcgttaacgatacgatgtgtaaacgtctgggtgcttctggggtagtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgcgcctgtagcaaaaccgcaggctgtaccaaacgcggtatctatcgcggagctggtatcgccgattaccggtgatgtcgtggcactggatcaggttcctgacgaagcattcgccagcaaagcggtgggtgacggtgtggcggtgaaaccgacagataaaatcgtcgtatcaccagccgcagggacaatcgtgaaaatcttcaacaccaaccacgcgttctgcctggaaaccgaaaaaggcgcggagatcgtcgtccatatgggtatcgacaccgtagcgctggaaggtaaaggctttaaacgtctggtggaagagggtgcgcaggtaagcgcagggcaaccgattctggaaatggatctggattacctgaacgctaacgcccgctcgatgattagcccggtggtttgcagcaatatcgacgatttcagtggcttgatcattaaagctcagggccatattgtggcgggtcaaacaccgctgtatgaaatcaaaaagtaatctgctttatgcctgatgcgacgcttgagcgtcgcatccaacaatgacaagcggtggagatcttctctgccgctttttttttcatcaatcatccccataatccttgttagattatcaattttaaaaaactaacagttgtcagcctgtcccgcttataagatcatacgccgttatacgttgtttacgctttgaggaatccacgatgagtgaggcagaagcccgcccgactaactttatccgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgttgagtcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccctgacgcaaccgggtaaaaacagcccgtaccgcgaccgcagcgttgaagagaacctggcgctgttcgaaaaaatgcgtgccggtggttttgaagaaggtaaagcctgcctgcgtgcgaaaatcgacatggcttcaccgtttatcgtgatgcgcgatccggtgctgtaccgtattaaatttgctgaacaccaccagactggcaacaagtggtgcatctacccgatgtacgacttcacccactgcatcagcgatgccctggaaggtattacgcactctctgtgtacgcttgagttccaggacaaccgtcgtctgtacgactgggtactggacaacatcacgattcctgttcacccgcgccagtatgagttctcgcgcctgaatctggaatacaccgtgatgtccaagcgtaagttgaacctgctggtgaccgacaagcacgttgaaggctgggatgacccgcgtatgccgaccatttccggtctgcgtcgtcgtggttacactgcggcttctattcgtgagttctgcaaacgcatcggcgtgaccaagcaggacaacaccattgagatggcgtcgctggaatcctgcatccgtgaagatctcaacgaaaatgcgccgcgcgcaatggcggttatcgatccggtgaaactggttatcgaaaactatcagggcgaaggcgaaatggttaccatgccgaaccatccgaacaaaccggaaatgggcagccgtcaggtgccgtttagcggtgagatttggattgatcgcgccgatttccgcgaagaagctaacaagcagtacaaacgtctggtgctgggtaaagaagtgcgtctgcgtaatgcttatgtgattaaggcagaacgcgtcgagaaagatgccgaaggtaatatcaccaccatcttctgtacttatgacgccgataccttaagcaaagatccggcagatggtcgtaaagtcaaaggtgttattcactgggtgagcgcggcacatgcgctgccggttgaaatccgtttgtatgaccgtctgttcagcgtgcctaacccaggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgatagccgccattctacggcggaaaaaccggtatttaaccgcaccgttgggctgcgtgatacctgggcgaaagtaggcgagtaattttaagtttcgctatgccggatggggcgtttacgtcgcatccggcaaggaacagacaaacagtttcaaacgctaaattgcctgatgcgctacgcttatcaggcctacatgatctctgcaatatattgagtttgcgtgcttttgtaggccggataaggcgttcacgccgcatccggcaagaaacagcaaacaatccaaaacgccgcgttcagcggcgttttttctgcttttcttcgcgaattaattccgcttcgcaatttatccataaaataaatttaaaataacaaaacataattaaataaaatgtaaccgctttcatcttgctggaatttcacgcttttattcttctgcaagcctttcaaccgcaaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctacttttttaatttttattttttcgctgttcacctttggtgcagcaatttatacgtcaaagaggattaacccatgcgtacgtttagtggcaaacgtagtacgctggcgctggctatcgccggtgttacagcaatgtcgggctttatggcaatgccggaggctcgcgccgaaggattcatcgacgattcaaccttaaccggcggtatctattactggcagcgtgaacgcgaccgtaaagatgttaccgacggcgacaaatacaaaaccaacctttctcactccacctggaatgccaacctcgattttcagtccggttatgctgctgatatgttcggccttgatattgctgcgtttacggcgattgaaatggcggaaaacggcgacagctcccacccgaacgaaatcgcgttttcaaaaagtaataaagcctatgacgaagactggtccggcgacaaaagcggtataagcctgtataaagctgcggccaaatttaaatacggtccggtttgggcgagggcaggttacattcagccaactggtcaaacgctgttagcgccgcactggagctttatgccaggtacttatcagggggcggaagccggggcgaattttgattacggcgatgctggtgcgttgagtttctcctacatgtggaccaacgaatacaaagcgccgtggcatctggaaatggatgagttttatcagaacgataaaaccaccaaagttgattatctgcactcctttggggcgaaatacgacttcaaaaataacttcgtactggaagcggcatttggtcaggcggaagggtatatcgatcaatattttgccaaagccagctacaaatttgatatcgccggtagcccgttaaccaccagctaccagttctacggtacccgagataaagttgacgatcgcagcgtcaacgacctttatgacggcaccgcctggctgcaagcgttgacctttggttaccgggcggctgacgtagtggatttgcgcctcgaaggcacctgggttaaggctgacggtcagcagggatacttcctgcaacgtatgactccaacctacgcttcctcaaacggtcgcctggatatctggtgggataaccgttctgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaaaaaccggactattgaagagtctgcctacagcctggatgcggtctataccattcaggacggtcgcgccaaaggcacgatgttcaaactgcatttcaccgaatacgacaaccactccgacatcccaagctggggcggtggttacggcaacatcttccaggatgagcgtgacgtgaaatttatggtaatcgcaccattcaccatcttctgatgcccgacgcggcaggttttgtgcctgccgcacgtttgaggaatttgctatgaaaaaactgattctcatcgccataatggcatcggggctggtagcttgtgcgcaatcaaccgcgccacaggaagacagtcgtctgaaagaggcatacagcgcctgtatcaacaccgcacaaggttcgccagaaaaaattgaagcctgccagagcgtgttaaacgtgctgaagaaagagaaacaacatcagcagtttgccgaccaggaaagtgtacgcgtactggattatcagcagtgtctgcgtgcaacgcaaaccggaaatgatcaggcggtgaaagccgattgtgataaagtctggcaggaaatacgcagtaataacaaataagtgagagctgtaactctcgcttttcttatttcccttgcataaaaaagccaacccgcaggttggcttttctcgttcaggctggcttatttgccttcgtgcgcatgttcatcttcgcggcaatcgccttcggcacagtgaccgtaaagatagagactgtggttagtcaggcgaatgccatgttttgcggcaatttcacgctgacgcgcttcgatggaatcatcactaaattcgataaccttgccgcagtcgaggcagatcaggtgatcgtggtgatgttgctgtgtcagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggatttttaaacgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcacagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcaactcttcagaaatctgtttaacccatttttctacacgttcagcggtcagttccggctgacggtcttcgtcgatagccagaccgacaaagtggtcgtcatctgccagaccttttgatgcttcgaaatgatagcccgcagttggccagtgaccaacgatggttgcaccgcgcggttcaatgatgtcgcggatggtgcccaatgcgtcgcagaaatattcggcgtaatcttcctggtcaccacaaccaaacagcgcaaccagtttgccgttgaaatcaatctcttcgagagtcgggaagaagtcatcccagtcacactgcgcttcgccgtaataccaggttgggatgcccagcagcagaatgtcataagcttccagatcttctttgctgctttttgcaatgtcatggacatcggcaacgtctttaccaagctgtttttgaatcatttttgcgatattttcggtattaccggtgtcgctgccgaaaaagatgccagtgatagccatgagtgaaataacctcttgaaacttattgaaatgggggtggaaaattgcccacggataaaggcaatcatagcagaacaggcagtcttgcggaatcagcaaacgagcaggactgcacactgtgctacatgaaagtggaaatttaaacgatgccctgactacgcagcgccgccagttgctgcattaacatctcttcgatcagttcgctacggctcatattgcgcgactccgccagctcgttcagcgcctcgacagcttccgcgttcagcttcagttcgacacgcttaaggccacgtactttgtcgcgttttagctggttgcgtttattaatacgcagctgttcatcgcgcgaaagcggattagttttcggtcgtcccggtcgacgctcgtgcgcgaacagatctaatgtcgtacggtccgtttgttctttggccatgatcttggtgacttcgggggaaacaatcagccaggcctctgcccggatggatagcgcgccataatacatcagcgcgatgagtcacgccaacgcccacgcgcggaaagcgacgcggacgctgggtttttaatcagttgcgttaatcattgagatagcgacggatagcgcgtaataccgcatccggtttttcagcatggacccagtgacccgcgcctgcaatcacatgcgcccgtgcctgtggaaattgagccagtaaatcatcacggtactgctcgctaacatacggagaattgccgccagggataaacagggcagggtgatcccatgccgggattttctcccaacctacaatatgcggatactgatcccacaataccggcacgttaaagcgccactccccgtcaacaaaagatttcagcagaaactgaatcaccccttcttcattaagatgctggcgcattattgctgctgcttgctggcgagtttgtgcgtccgattcactgaccgcgttgatagccgcaaaaatctcatcatgacggcgtacgtgatagtcgaccggcgcgatatcgatcgccaccagtttatcgatgcgatcggaggctagtgcagtaagtgccattaccgctttaccgcccatggagtgaccgataaatgttgctttgtcgatctgctgtgcatccagagtatcaacaagatcctgcgccatcgccgggtaattcattaccggatctctcggtgaaagaccgtggttacgcatatcaacctggatgatattgtgatcgtttaccagatcgcgagccagtacgccaaggttgtcgaggctgccaaacagaccgtggacaagaacgatgggagaattattgtgctggttttgtgcagtttgcgcgcggatattcaatttcatggcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgaacctgcattcatttccgttctggaagtgctggcagcgaacggcgttgatgtcattgtgcaggaaaacaatggcttcaccccgacgcctgccgtttccaatgccatcctggttcacaataaaaaaggtggcccgctggcagacggtatcgtgattacaccgtcccataacccgccggaagatggtggaatcaaatacaatccgccaaatggtggcccggctgataccaacgtcactaaagtggtggaagacagggccaacgcactgctggccgatggcctgaaaggcgtgaagcgtatctccctcgacgaagcgatggcatccggtcatgtgaaagagcaggatctggtgcagccgttcgtggaaggtctggccgatatcgttgatatggccgcgattcagaaagcgggcctgacgctgggcgttgatccgctgggcggttccggtatcgaatactggaagcgtattggcgagtattacaacctcaacctgactatcgttaacgatcaggtcgatcaaaccttccgctttatgcaccttgataaagacggcgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcaatcaattacctgttccagcatcgtccgcagtggggcaaagatgttgccgtcggtaaaacgctggtttcatctgcgatgatcgaccgtgtggtcaacgacttgggccgtaaactggtagaagtcccggtaggtttcaaatggtttgtcgatggtctgttcgacggcagcttcggctttggcggcgaagagagtgcaggggcttccttcctgcgtttcgacggcacgccgtggtccaccgacaaagacggcatcatcatgtgtctgctggcggcggaaatcaccgctgtcaccggtaagaacccgcaggaacactacaacgaactggcaaaacgctttggtgcgccgagctacaaccgtttgcaggcagctgcgacttccgcacaaaaagcggcgctgtctaagctgtctccggaaatggtgagcgccagcaccctggcaggtgacccgatcaccgcgcgcctgactgctgctccgggcaacggtgcttctattggcggtctgaaagtgatgactgacaacggctggttcgccgcgcgtccgtcaggcacggaagacgcatataagatctactgcgaaagcttcctcggtgaagaacatcgcaagcagattgagaaagaagcggttgagattgttagcgaagttctgaaaaacgcgtaaacacatttaataaaaaaagggcggtcgcaagatcgcccttttttacgtatgacaaacacagaattgcctgatgcgctacgcttatcaggcctacgaggatggtgcaatatattgaatttaagcgattttgtaggccggataaggcgttcacgccgcatccggcaaaaacaacgaacactttgtcaacaaactgagtagctcaaggaaatcccaatgaagaccaacaggagtctggtcgtcatagtgtcactaattaccgccacattactgctgactgcatgcgcccaacctgaacaatcatcattagctggcgactggttactgacccctaaagataaaaccagaggattaacgggtagcattgcggtaaatattgcacctttccggtgtaagacaaattgccgtggtgataacttacctgataatacccgccgctggcagttgtcaggcgggaacgaaaaagaacttacttatcttcataatatgtcagcacaagaaaaggtcggtttaaatcccggttggcaatgctacacctcattttttatgcgggtttgccagggcaagcccggcactcgaccgatagtcaatgaggattatgtcagcgaaagcggattttttggctcgatgatgcatgtcgggattattgagttacgacgctgccagtcagaaaattgccagcaagaattgaaagcgataaatacacattaaaatagtgagtccgggaatgaaacccggacctgaacatgtcttattgcgtgaatgtttctttcatttgatactgcatttcccagagttcagtaagcgaaataacttttcttgttcttgcttcttcactttgtacccataagaaagggtagaacgtgaaggcttccgttgccgataattttattacgtcttctcgccattgctgccatcgtacattttcatagaaggtatctaaatcaccggataatgcccactgaagaaactcagaatatccaacttccagactttcccaattcagcgtatctggcgcaaaataataaacgcagccagtatcttccccaagatcgccaccattaagagcaaaaattacccctgcgacatcgtcagcgatgggtaaagcccgcacgcctgcgaattcagggcgttgtgtccaacttactggatctcgtggcaaccgggggtgaccagatcctgctatgcgtaactaaccattatcaatcagcagacctccggagccatagacaagcgcacccatcggtgattttgttgtcacctgtaattgataaagtgcggtttcggctaaatctttattaaccggtaagagttcggtatggtttgtggcgtcttttaaccagttctggattattggccaggctgaatcttcagtatttactaactgattcatttcacgcatcgctacttgctccttgtgtgctacggtgtcatttatgatgaggaattgtatggaacattttttaaatattaagttccttatatttgaataaaaaatgactttatccatacattgccacttttttcaaagcataaaccgatacccaataccggtttcagtaataaaatggcgaggccgggccggatcctgttccagtttttgtcgcagatgccccatataattacgcaaatagttgctgtgttcgatcgcgtttagaccctacatctgccggatgcggcataaataacgaactatttgccaacaaacagaaagggcgatcattcaatcgcccttttttactttgttttattaaccgtgtttatttttcagttcaaagcgtggtgataccagaccatacagtgtccaaccaaggaaggtcacgatggaaccgtacagcatggcttcttccccggatgagtacagcgcataaaagctatacatcgcgccaacaaaagcaacaaagtttgcaactttcgcttttgaggggggcacattagcgaccttctgaataatgactaatgccgccattgacagaatatacggaatgatattggtcaccacggccaggttaaccagcacgttgaactgactgtttagcgacgggctaatggtcatcagtgccaatccactctgaataatcacaatggtcaacattccctgcaccggtgcatccactttggttacacgggagaaaattttagggaagtagccttcatcagatgaagatttaaacacctgggcaatggtgaactgccagccaagtagcgaaccgcagcaggacatcaccatcagcgccataatgactttacccacttccggcgtgaacatctgcgcgaaggccagaccaaatggtgccgttgaatttgccagctccatatttggcacaatcccggcaatcacgttggtggagacgatataaatcaccgccgcacctaacgtaccgccgagtaccgcgattggcacattacgttccgggttttccactacatcagtattcgcacacgcagactccagaccaagaaaagcccacagcgtcatagcgatggaagaacctaccgcactgaagaacggtgcatgatgcggattccaggaatcaacgtacagcgtcgggctaaaccagaaccagccaataatgcacagaccgacgaccggaataatgaccccccacacggtaatgctactgatttgcccggtaatgcgcgcaccaccaaagttagccacggtacaaatccacagcaccccgatggtcgcaagaccaatctgcactggcgacaaactcgcgccgagcagttcggtgccgtaaccaaccgccgaaatagcaatcgcgacgttagcaatcagcagtgagacgccgtaggtatagttcgccataaagttaccggatttaccgaaagcatactcggcataaccgcccataccgcctgatttacggctgaacataccgcattttgcgaatgcccatgccagtgccattgagcctacggctgtcaccagccaggagataattgagattgtcccgacttcggcaagctttgtcggcagcatgatgataccggagcccatcatgttgaccatcgtcagtatggttaactgaacgacgcccattttgttcgatttagcctgactcataatttttcccctttcaacagggtgctttgcgcatcacgaggcttgatgacatagcaccaaacttgcttacgaccatcatgttcttcgatatagacaccctgcagctccggtgcaaaacctggcagcaggttgatcccttcttccagagcgctgaagtaacgcagaacagcaccaccccagatttcacccggaacaacacacagcacacccggaggataaggaagcgcaccttcggcagcgatacggccttctgcatccggcagacgaaccagttccacttcaccgcgtaaataggcgtagttggcttcttgcggattcatgctgacgcgtgggaagtgctccttacggaacatctctttttgcagttgtttcacgttgtggcgggcatacaaatcatgcatttcctgacacaactgacgcagggtataaccggcgtagcgctcttcatgctgtttgtagatggaaggtagcacttctgctaatggcgcgtcggactcaagcagtttttcgaagcgtaccagcagggcaacaagttgctgaagtttggccatatcttctgccggagtcagcaggaagaggatggagttaagatcgcatttttccggcactacgccattttcgcgcaggaagttagcaagaatcgtcgcgggtacaccgaacgcttcatattcgccgttacgtgcatcaatacctggggttgtcagcaacagtttgcatggatcgacaaagtattgattctctgcatagccttcaaaagaatgccagtgttcccctggtacaaactggaagaagcgcagatcaaccgcaatttgcgctgtttcatacgactgccagggtttaccatccaccagttcaggtacgaacggacgaatatgctgacagttatcgaggatcagtttgcgggcattaatgccatttaccacacaatccatccacatattacgaccgctgacaccttcatgcattttggcgttgatattcagtgcggcaaacagcggatagaacgggctggtggaggcgtgcatcataaaggcgttgttcatgcgtttgtgcggtacataacgctgttgccctttgatgtggctgtcttttttatgaatttgtgaagtctgagaaaaaccagcctgttgtttatgcacagattgcgtaaccagaatacccggatcgttctcattaagatccagcaacagcggcgaacagtccgccatcatcggaataaactgttcatagccgacccatgctgagtcaaacaggatgtagtcacacagatgaccaattttatccaccacttggcgggcgttataaatcgtaccgtcgtaggtgcctaactgaatcacagcgaggcggaaaggacgagcctcttttgcccgctgcggtgcgacttccgcgatcagctcacgcaggtaactttcttcaaaacagtgcgcatcaatgccaccgataaagccatacgggttacgtgccgtttccagataaaccggtgttgcaccagcctgtagcaacgctccgtggtggttagatttgtggttattgcgatcaaacagcaccagatcacccggtgttagcagggcgtttaaaaccactttgttagaagatgaagtgccatttaaaacgaagtaggttttatcggcattaaacacttttgccgcatgttgctgtgcaatgcatggcgcgccttcgtgaatcagcagatcgcccatcgctacgtcggcgttgcacaagtcggcacggaacagcgcctcaccaaagtattccacaaactgattccccgccggatggcgacggaaaaattcgccgccctgatgaccagggcaatcaaacgcgctgttaccttgattgacataatcgaccagtgcgcggaagaaaggtgggcgcagttgagtttcataatggctggcagcggtttctaactggcgaccataaaattctcgtcgcgattcgcaattctcaaagacacccgaaatacggggcaaatactctgcgggtacacgttcttgattttcagtagcaataaataccgggatgccataacccgtggcatcgatttcatcgagttttccgcatgtaacatcgttgagcgataaaactattgccgccacatcgatattacgactttcattaatgtagatacattctcgctgcgtggtaaaacagtccgggcaagaatcactaaccgcaatttttaattttgacatttttcatctctttattttaggtaatagcaggtcctcaatttctcgaatgagaaatcgatcgtgccggaaaaaagcaaagttaccccgctgataaataaatcaggtagattgcttttttcagaatgcagaaacccttaccagtcaggtggctgataatacaagggttaacagagaatgagcactgcggaatacaggcatatgcctgtaatacagagagtcaggaagacctgtacgctgaagtgcccttagtcggtagactaacgggcattgaagaagtgaaagtcgaagctattgcgatgagcaaacttcataatatgagttgtccgccttatatggggcatagtgcggctgttattttccatttaatttacctttcctgatgtgaatgaaggtgaagatattctatccaggaaatacggttgaactgtgaaggtgatcaataaaaaatgatcaatcttaatttatttaatgatgagctttttactcagtaatataaaatattgaattgttatttttgtgtgttgtttaagataaaaagccgtatttattattacggctttaattaataaaaggcaggctgtattaaaattaatattcaaagcataaaccgatagccaataccggtttcagtaatgaaatggcgtgggcgggcgggatcctgttccagtttttgtcgcagatgtcccatataaatacgcaaatagtgactgtgttcgaccgcgtttggcccccacacctggttaaggagctggcgctgggtgagtacttttccggcattgttgagcagcaccgccagcaggcggaactcaattggtgtgagatgcacctcttcctcaccccggtgaatcacgcgggcggctaaatcgacggtaacatcggaaaattttaccagcggatcgggcgcggtggtggcagagtggcggcgtaatgcgacgcgcagacgggcctgcaattcgccaatgccaaacggcttactcagataatcatccgctccggcatccagcgcggcgattttgtcgctctcttcgctgcgtgcggaaagcacaatcaccggcaccgcgctccactggcgcaggtcgcggataaactcaatcccatcaccatcgggcaggccgagatcgagaataatcaaatctggcttacgggttgccgcttccagcaagccgcgttgcagcgtttcggcctcaaagacgcgcatcccgtcgccctccagcgccgtgcgcagaaagcgacgaatagcctgttcatcttcaacaatcagaacgtttgtcacatatcctcatgaaattcttcaagttcaggggcagtttgctggggaagtgtaacacgaaaacaggcaccaccttccggtcggttgaacgcggtaatagtgcccccgtgtacatccactatcgcccgacaaattgccagtccaagccctacccccggtactgccgactctttattcccgcgagcaaacttatcaaatatcgtctgctcctggcctggcggaagaccggggccgttatcccagacatccagttgtagattttcgccctcaacgtgggcatcgataccaatttcggcctgcgcacccgcatatttcaccgcgttctccagcagattaatcagcacccgttcaaagagtggcccgtcaacgtggattaaggtcagcggttctggcagagaaagattgatgggcgacgataaacccggttccagcatttgcagcgcgctgccgactacttcttccagcgttaaccactctttcttcaaattaaagccgccggactgaattcgcgccatatccagtagattattcaccagtcgggtagtgttcagcacatgctgacggatctcgctggcctggcgggcgtggggtgatccttcgcttgccagatcgagcgttaagatttctgcctgaccaaacagcaccgtaagcggcgtgcgtaaatcatgcgaaagcgccgccagcagggcgttgcggatctgttcacgttcgcttgccatccgcgcctgttcttcgctggcggttagcgtcagccgctcaagggcattggcgactaacagcgtaaacgtctccagcaggcgctgctgttccgggatcatcaactggcgcagattccccggctccaccaccaccagcccgtaggttttctcgccgctttttagcggcaaaatctggtacggtacaccgggtaacgtgtcggtgcccgcgcccgcaggcaggcctttatcaaaactccactgcgcgatggcatcgtcccacggcgtcattccttgcggatgtgttaacggctgcaatttaccgttgtcatcgggcaacaacacctgactgcgggcatgaaacgtggaggcaataaattgttcgctggtggcagcgatatcctgcggactgcggcccaccgccagagctttcgacatttcatataagtgccgtgtgcgttgctcgcggtaacgggctacccgcgcctgataacgcacgccagcagtaaggttcccgatcaccagcccgacggttaacatcaccgcgaaggtcagcagatattgcacatcagagacggcgagcgtgccgcgtggggcgataaaaaagagatcgaaactcactacattaatgacggtggcaaccactgaaggccagcgtccataaaatagcgccaccaccaccacgccaagcagatacagcatcaccaggttggcggcatcaaacgccatcagccactgcatggcaattaaggtgataacggcgcataacgcggcggcaaccacgcatccctgaatttgtacacgccacttgtctttaaaagagcggttatccggcgcgttgttaatcgtgcgggcgggtggttcatcaagcgcgaccagcacctgatcgagatcgggggcgatgcgcgccagtcggtcagcaaacgtttcccgacgccaccagcggcgcgaggccgggcgaccgagaataatcttgccgagattatgttcacgggcataacgcactaccgctttctcttccgctggatcagaaagtgttgccgtctccgcgcccagttcctgcgccagacgtaaggcgctgagaattgcccgacgttttttttccggtaagcggtgcagggcaggggtttcaacatacaccgcgtgccagacgctacccagccgtgacgccagccgcgccgctgcgcggaccagtttttcgctgccggtgttatggccgatgcataaaaggatcgcgtcgcgcgtgtgccacactttctcttcgccaggatgcccccgccaggcgcgcatttgctcatcaacgcgatcggcagtacggcgcagtgccagttcgcgcagggcgatcagattacctttgcggaaaaaatgttcaatggcgcgctccgcctgcccggcaatatagactttgccttctttcagccgctggcgcagatcgtccgggggcaagtccaccagcaccacgtcgtcggcggcatcgaaaaaaggatcgggcacggtttcccgtacctgaattccggtgacgccgctgaccacatcattcagactttccagatgctgaacgttgacggtagtgaaaacatcaatgccagcttccagcagttcttcgatatcctgccagcgtttgggatgacgggaacctggcgcattactgtgcgccagttcgtccattaagatcagcgccgggcggcgggcgagggcggcatcgagatcaaactcgctgatatgccgcccacggtacgcctggcgttttaacggcagaacagccagcccttccagcatggcggcggtatcttttcgcccgtgggtttctaccacgccaaccacaatatccagcccttgcgcccgcagtcgctgggcttctgccagcatcgcccaggtcttcccgacgcctgcacaggcaccgaagaaaactttcagcttcccccgatgcggcgcggcagtttgttccagcagacgatcggggtcgggacgtaagggttcgttattcatcaagtttatccagcgccagattgagttcaacaatgttgacaaccggctggccgatatatttcaccagcggttgttggctgtattttgcgatcagttgcgtgagctgttcaacgctgagattacgcgctttcgccacgcgtgggatttgccaggccgccgcttgcggggtgatattattgtccagcccgcttgccgatgccgtcaccagttcaaccggaacgctcgcgctggcatccgggttagcggcccgtaatgcagcaacgcgtgcggctattagtttatccagctcagggttactgaccgccagattgctcccgccagaagcctgtggattatagggcatttctgccgttgccgacgggcgaccatgaaaatagccgttgccggtaaaattctgcccgattaatgccgaaccgcgcaccgtatcaccttcacgaatcaacgaaccattggcctgccagggaaaccaccattgccccagtacggtggtcagcagcgggtaaacgccgccagtaatcaataacagaaagataaatgttgataatgccggacgtaatccactcatggtaaacctcacaccagaccgcaaacggtcagcagtaaatcaatgactttgataccgataaacggcaccagcagcccacccagaccgtaaatccataagttacggcgcaacatggcagaagcggtaagcggtttataactcacgccttttaacgccaggggaatcaaaaagacgataatcaaggcgttgaaaatcaccgcactgaggattgcggagtcgggcgaatgcaggcacatgatgttcagcgcatttaactgcggatacgttgccgcgaatgccgccggaataatggcgaagtatttcgccacatcgttggcaatgctgaaggtggtcagcgagccacgggtcatcagcatctgtttgccaatgtgcaccacctcgatcaacttggtcgggttagagtcgagatcgaccatattgcccgcctctttcgccgcctgggtgccggagttcatcgccaccgcgacatctgcctgcgccagcgccggagcatcgttggtgccgtcgccggtcatcgctaccaaacgaccttccgcctgatactgacggatcaatgccagcttggcctccggtgtcgcttcggcgagaaaatcatcgacacccgcttccgcagcaatcgcggcggcagtcagacggttatcgccggtaatcatcaccgttttaatgcccattttgcgcagctgggcgaagcgctctttaataccgcctttgacgatatctttcagcgcaataacgcccagcacacgagaaccttccaccaccaccagcggcgtggctccctgacgcgcaacctgatcgactttttgatcaacatcggtagggaagtgaccaccgttagcctcaacatggcgacgaatggcatcgacagaacctttacggatcatgcggttgtcgatgttgatcccgctcatccggctttgcgcagtaaacggtacaaaggtggcatggagcgactgcacatcgcgctcgcgcaggttaaaacgctgcttggcgaggatcacaatactgcggccttccggcgtttcatcagccagcgaagccagttgtgcggcgtcagccagcgttttttcatccacgccctgcgcggggataaactccgacgcctgacggttaccgagtgtgatggtgccggttttatccagtagcagaacgtcaacgtcacctgccgcttcaactgcacgtccgctggtggcaatcacattcgcgcctagcatccggctcatcccggcgacgccgatcgctgacaacaggccgccaatagtggttgggatcagacagaccagcagcgccaccagtaccgttacgctgactgcattaccgccccacgcggaaaacggccacagcgtggcggttgccagtaaaaagacgatagtcagggcaatcagcagaatggtcagggcaatttcgttcggcgttttgcgtcgctgtgcgccttccaccatcgcgatcatccgatccagaaatgtctcgccggggttaacgctacactcaatcaccagccagtcagaaagaatacgcgtgccgccggtgacggaggcaaaatcgccgccggattcacggatcaccggtgccgattccccggtgatggcgctttcatcgaccgatgcacccccttcaataacttcaccatcgcaggggataatatcgccagcttctaccagtacgatatcgcctttacgaagttggtcggcaggaactttgtccgccgcagcgccatatttcggctcacgcagcttgcgggcaaaggcagtttttttcacccctttcagactgttggcctgcgctttactgcggccttctgccagcgcctcggcgaaattagcgaacagtacggtgatccacagccaaccgctaatggccgcgctaaacagcgcattgccgggcatcgcaccgcttgccatcgcgatgctaatacaggtggtcagcagactgccgatccagacgataaacatcaccggattgcgccattgcgcctgcgggtttaattttttcaccgcttctttcagcgcctgaacgacaagtgttggttcgaatagcgccagttgtttacgactcatattcagtgctcactcaatatcatcaggagagatattccgccaccggaccaagcgccagggcagggataaaggtcagtgcgccaaccagcaacacggtgccgattaacaggccaacaaacagcgggccgtgcgttggcagcgtgccggagctggcggcttggctctttttactcaccagcgaaccggcaattgccatcaccgggataatcaccccgaagcgaccgacaaacatgcagaacgccagtaaacagttccagaacggagagttggcgcttaatccggcaaaggcgctgccgttgttgttagcggcggatgacacggcgtacagcacttcgctaaaaccatgcgggccagggttgagcatggcgctacgtccggcgtcggtcatcatcgccaacgccgcgcccatcagcaccagcgtcggggtaaccagaattgccagtgcagtcagtttcatctcgcgtacgtcgatttttttacccagatattccggtgtacgaccaatcatcagcccggcaataaacaccgccagcaggacaaacagcatcatgccgtaaagaccagaaccgacaccgccgaacaccacttcaccaatttgcatcagccacatcggcaccatgccaccgagagcggtaaacgaatcatgcatcgcaatcaccgcgccacaggaagccgccgtcgtcacgaccgcaaacaggctactgaccagcacgccgaaacggctctctttaccttccatattgatgctgctgtccgtgcccagtgccagcagatgaggattaccctgaacttctgcccacatcaccacgcctacgcagatgacaaaaatcactgacatcgcccacagcaacatgcgcccctggcggcgatcgcccatcacttcaccaaaggcaaagcacagcgccgttgggatcaagaagatcgccagcatctgcacgaagttggtcagtgcggttgggttttcaaacggatgcgacgagttggcattaaagaagccaccgccgttagtaccgagcatcttgatcgcttcctgagaagctacaggccccatgggtaacagctgttgcgctccttcaacggtattcacagcctgataaggcagaaagttttgcagcgcaccttgttgaataaaaaacagtgcaatcaacaacgccacagggactagcacccataacgtgatgcgtagcagatcgacccaggcattcccgagcgtgctcatgctctggcgggtaaacgcacggatgagggcaaaaatcaccgcaatcccgctggcggcagaaagaaagttttgcaccgttaagcccgccatctggctgaaatagctcaacgtggtttcaccgctataagattgccagttggtattggtgacaaagctgacggcggtattcagcgccagatcccacgacagccctggcaactgctgtggattaagcggcagatagtgctgaccgagcaacataaaaaacagcaccgccagccccagcatgttcaggccgagaatggcacaaagatattgcttccagttcatctcacggtcagagacgccaagtgcgcgaaaaagtacgcgctcaacgcccgttgtaccgggaagaggaatgtcattaatcagccgcgccagcccgctgcctaaaggacgcgccagcaccattaacaccagtaaaaacgtggcgatcagtaagaacccttgcgcagccatcagaacgcctccgcattgatcagggcataaaccagataacccagtaataaaaacaccagcaatacgccggttatcacgcctgcactcacagtgcacctccagtggcctaaaagtgataccggaagggtagaattctggctgcaaagatttcgcaaaaatctgcgggcggggtgtaaaaaaagtataaaaatggcaaaagccatgatttaactaatgtttagtattaatttaacttttgtgtaacttaattacaggatgaatgtaaataaaccatcaataagcaaaaataagtggtcggatgagtagtaaaattacacaaaaggcggtactattttcatcagataaacaaattcatttttccggtgccattcaccgggtagatacaaaagggggagaaaagtatggaactctacagagaatatcctgcatggcttatctttttacgccgtacttatgcggttgcagcgggcgttctggcgctgcctttcatgcttttctggaaagaccgcgcccgcttttacagctacctgcatcgcgtctggtcgaaaaccagcgataaaccggtgtggatggatcaggccgaaaaggcaactggtgatttttattgattgctgagttttgaatacattgaaaaccgccagcggaaacgctggcggttttttgtatcaggaagatgttcagaggaatatttagacatcgttataccaatcgaaacatatattcatgaaatatatataaatattttcctaattgttcttatctgacagatatctcacttaaggctttcttataaatctgtagggtttcgcctgtcagcagacaaataacccgataaaacaaggatgagcagatgagcggaaaaccggcggcgcgtcagggcgacatgacgcagtatggcggtagcattgtccagggttcagccggggtacgcatcggtgcccccaccggcgtggcctgttcggtgtgccccggcggggtgacgtccggccatccggtcaatccgctgctcggtgcaaaggtccttcccggtgaaaccgacatcgccctgcccggcccgctgccgttcattctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggctggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccccgcggcgaactggcggcggtgtatgaccgcagcaatacacaggtgcgcagctttacttacgatgataaataccggggccggatggtggcgcaccgtcacacgggccgaccggaaatctgttaccgttacgacagcgacgggcgggtgacagaacagctaaacccggcaggcttaagttacacgtatcagtatgagaaggaccgcatcaccatcaccgacagcctgaaccgccgtgaagtcctgcacacgcagggtgaaggcgggctgaagcgggtggtgaaaaaggaacacgcggacggcagcgtcacgcagagtcagtttgacgcggtgggcaggctcagggcacagacggatgccgcaggcaggacaacagaatacagtccggatgtggtgacgggcctcatcacgcgcatcaccacgccggatggcagggcatcggcgttttactataaccaccacagccagttaacgtcagccaccgggcctgacgggctggaaatacgccgggaatatgatgaatggggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcactgactgttccggttatgtaacccgctatgaccatgaccgttttggtcaggtgacggcggtgcaccgcgaggaagggctgagtcagtaccgcgcatacgacagccgtggacagttaattgccgtgaaagacacgcagggccatgaaacgcggtatgaatacaacgccgccggtgacctgaccaccgtcattgccccggacggcagcagaaacgggacacagtacgatgcgtggggaaaagccatctgtaccacgcagggcggtctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacgacctgaccggcaaacttatccgcagcgaggatgaggggctggtcacccactggcactatgacgaagcagaccgcctcacgcaccgcaccgtgaatggcgaaaccgcagagcggtggcagtatgacgaacgcggctggctgacagacatcagccatatcagcgaagggcaccgggtgacggtgcactatggttatgacagtaaaggccgcctcgccagtgaacacctgacggtgcatcatccgcagacgaatgaactgctctggcagcatgagaccagacatgcgtacaacgcacagggactggcgaaccgctgtataccggacagcctgcccgccgtggaatggctgacctacggcagcggctggctgtcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtataccacagacccggcaggtaaccgcctgcccgacccggagctgcacccggacagcgccctcagcatgtggccggataaccgtatcgcccgtgacgcgcactatctttaccggtatgaccgtcacggcaggctgacagagaaaaccgacctcatcccggaaggggttatccgcacggatgatgagcgcacccaccggtaccattacgacagtcagcaccggctggtgcactacacgcggacacaatatgcagagccgctggtcgaaagtcgctatctttacgacccgctgggccgcagggtggcaaaacgggtatggcggcgtgaacgggacctgacgggctggatgtcgctgtcacggaaaccgcaagtgacctggtacggctgggacggcgaccgcctgaccacgatacagaacgacagaacccgcatccagacgatttatcagccggggagcttcacgccactcatcagggttgaaaccgccaccggtgagctggcgaaaacgcagcgccgcagcctggcggatacccttcagcagtccggtggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggcgcagatgcaaagccagatggacccggtatacacgccggcgcgaaaaattcacctgtaccactgcgaccatcgcggcctgccgctggcccttatcagcacggaagggacaacagcgtggtacgcagaatacgatgaatggggtaacctgctgaatgaagagaacccgcatcagctgcagcagcttatccgcctgccggggcagcagtatgatgaggagtccggcctgtattacaaccgccaccgctattatgacccgctgcaggggcgatatatcactcaggatccgattgggctgaaagggggatggaatttttatcagtatccgttgaatccgatctcaaatatagatccattaggattagaaacactaaaatgcattaagccactgcattcaatgggcggaactggtgaaagaagcggtccagatatatgggggaatccgttctatcatcaatatctttgtgtcccagatggtaaaggggactatacttgtggtggccaagaccaacggggagaatcaaaaggagatggtctatgggggccaggtaaagcaagtaatgatacaaaagaagctgctggccgttgtgacctcgttgaaaccgataatagttgtgtggagaactgtttaaaagggaagtttaaagaggtaaggccgcgttattctgtattgcctgatatattcacacctataaatttagggctatttaaaaactgccaagactggtctaatgattctttagaaacatgtaagatgaagtgctccggaaataacattggacgttttattagatttgtattcaccggagtgatgtaatgaaatatattatttttttattcagagctatatggctggctttatcgcttttaatactattcttttccatgcatagactttcactattagactccactcgtgatgtgagcgagttaattagtctcatgtcttatggaatgatggtaatatgttttccaacaggcatagtattctttattgctctaatatttatagggactgtatcagacattattggcgtaaggattgatagtaagtatattatggcgataataatatggctttattttctgtcaggagggtatattcaatggtttgtattaagtaagcgcattataaacaaataaattaagttaattgctcttattattatatgtaacctgggcattgatatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacggagaaaaccgacctcatcccggaaggggttatccgcacggatgatgagcgcacccaccggtaccattacgacagtcagcaccggctggtgcactacacgcggacacaatatgcagagccgctggtcgaaagccgctatctttacgacccgctgggccgcagggtggcaaaacgggtgtggcgacgtgaacgggacctgacgggctggatgtcgctgtcacggaaaccgcaagtgacctggtacggctgggacggcgaccgcctgaccacgatacagaacgacagaacccgcatccagacgatttatcagccggggagcttcacgccactcatcagggttgaaaccgccaccggtgagctggcgaaaacgcagcgccgcagcctggcggatacccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggagcagatgcaaaaccagatggacccggtgtacacgccggcgcgaaaaatccacctgtaccactgcgaccatcgcggcctgccgctggcgcttgtcagcacggaaggggcaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggaggtatatcactcaggatccgattgggctgaaggggggatggaatttttatcagtatccgctgaatccggttcagtatatagattcaatgggactggcatcaaaatatggacacttaaataatggcggatatggagcgagacccaacaaaccgcctacgcccgatccaagtaaattgccggacatagcgaaacaattaagactgccatatcctattgaccaggccagtagtgcgcctaatgttttcaaaacattcttcagagcattaagcccttacgactacacactgtattgcaggaagtgggtaaaaccaaatctgacttgtacgccacaggatgattcccagtatccagggatggatacaaagacagcaagtgattacctgccacagacaaattggccaacaactcaattaccaccaggatatacttgtgcagaaccctatttattcccagacattaataaacccgatgggccagcaacagcagggatagatgatttgggtgaaattttagctaagatgaaacagagaacatcgagaggaataagaaaatgaaaagagttttgttctttttgctgatgatatttgttagttttggtgttatagctgattgcgaaatacaagctaaagatcatgattgttttactattttcgctaagggtactattttttccgcgtttcctgtcttaaataataaagccatgtggagatggtatcagaatgaggacatcggtgagtattattggcaaacagaactgggtacatgtaaaaataataaattcacaccaagcggggcgagactcttaattcgcgtcgggtcactacgccttaatgaaaatcatgccatcaaaggaacgttgcaggagttgataaatacagcagaaaaaacggcgtttctcggcgatcggtttagaagttatataagagcgggtatctatcaaaaaaagagcagtgatccagttcagttgttggcagtccttgataattcaatcatggtaaaatattttaaagatgagaaaccaacttatgctcgaatgacagcacatctcccgaacaaaaatgagtcttacgaatgtttaataaagatacagcatgaactaattcgtagtgaagagaaataaaatctcttcctgagaaaacaaattaatcattgtgaaaaattatataactcatggaataggtgtttattttgcgttccatttgcagggaaagatcacgtaacgctacttttttgtactaaataattcgaattttaagttcaacaattgagatactacttattgtctaaagctgtttttcatagcttatacatgatcaaatactccttacataaataaggtgaacaaatggaacttaaaaaattgatggaacatatttctattacacccgattacagacaagcctggaaagtggtgcataaattgtcagatattctactgttgactatttgtgccgttatttctggtgcagaaggttgggaagatatagaggatttcggggaaacacatctcgattttttgaagcaatatggtgattttgaaaatggtattcctgttcacgataccattgccagagttgtatcccagggaaagatcacgtaacgctacttttttgtactaaataattcgcattttatgtttaaaaattgagatattccttattacctaaagctgtttttcatagcttatacatgatcaaatactccttacataaataaggtgaacaaatggaacttaaaaaattgatggaacatatttctattattcccgattacagataagcctggaaagtagagcataaattgtcaggcatcctactattgactatttttgccgttatttctggtgcagaaagttgggaagatatagaggatttcggggaaacacatctcgatttcttgaagcaatatggtgattttgaaaatggtattcctgttcacgatactattgccagagttgtatcctgtatcagtcctgcaaaatttcacgagtgctttattaactggatgcgtgattgccattcatcaaatgataaagacgtcattgcaattgatggaaaaacgctccggcactcttatgacaagagtcgccgcaggggagcgattcatgtcattagtgcgttctcaacaatgcacagtctggtcatcgggcagatcaagacggataagaaatccaatgagatcacagctatccctgaacttcttaacatgctggatattaaaggaaaaatcatcacaactgatgcgatgggttgccagaaagatattgcagagaagatacaaaaacagggaggtgattatttattcgctgtaaaaggaaaccaggggcggcttaataaagcctttgaggaaaaatttccgctgaaagaattaaataatccagagcatgacagttacgcaatgagtgaaaagagtcacggcagagaagaaatccgtcttcatattgtttgcgatgtccctgatgaacttattgatttcacgtttgaatggaaaggactgaagaaattatgcgtggcagtctcctttcggtcaataatagcagaacaaaagaaagagccagaaatgacggtcagatattatatcagttctgctgatttaaccgcagaaaagttcgccacagcaatccgaaaccactggcacgtggagaataagctgcactggcgtctggacgtggtaatgaatgaagacgactgcaaaataagaagaggaaacgccgcagaattattttcagggatacggcacatcgctattaatattttaacgaatgataaggtattcaaggcagggttaagacgtaagatgcgaaaagcagccatggatagaaactatctcgcgtcagtccttgcggggagcgggctttcgtaatctttccctgctttttgtactaaataattcgcattttatgtttaaaaattgagatattccttattacctgaagctgttttttattgcttatacatgatcaaatacttcttacataattaaggagaacaaaatggaacttaaaaaattgatggaacatatttctattatccccgattacagacaagcctggaaagtggaacataaattatcggatattctactgttgactatttgtgccgttatttctggtgcagaaggctgggaagatatagaggattttggggaaacacatcccgattttttgaagcaatatggtgattttgaaaatggtattcctgttcacgataccattgccagagttgtatcctgtatctgtcctgcgaaatttcatgagagctttattaactggatgcttgactaccattcttcagatgataaagacgtcatcgcaattgatggaaaaatacaccggcattcttatgacaagagtcgccgtaagggagcgattcatgtcattagtgcgttctcaacaatgcacagtctggtcatcggacagatcaagacggataagaaatccaatgagatcacagctatccctgaacttcttaacatgctggatattaaaggaaaaatcatcaaaaccgatgcgatgggttgccagaaagatattgcagagaagatacaaaaacagggaggtgattatttattcgctgtaaaaggaaaccaggggcggctaaataaagccttcgaggaaaaatttccgctgaaagaattaaataatcccaagcatgacagttacgcaattagtgaaaagagtcacggcagagaagaaacccgtcttcatattgtttgcgatgtccctgatgagcttattgatttcacgtttgaatagaaagggcagctatggttagaaactacctgacgtcagtccttgcggggagcaggctttcgtaaatttgtcctgctacaacaggattaacttcacaaatatcatttctcaacgtctacacttactcctgtaaaccgctcaggagcagtaatgaatctacaacgatttgatgacagcaccctaatccgtatctttgcccttcatgagttacatcgactgaaagaacatggcttaacgcgcggggcgcttctcgattatcacagccgctataaactcgtctttctggcgcattctcagccggagtaccgcaaacttggcccgttcgtggctgatattcaccagtggcaaaatctggatgactattacaaccagtaccgccaacgcgtagttgttttgctttctcaccccgccaacccgcgcgatcacaccaatgttttgatgcacgttcagggttattttcgcccgcatattgattccacagaacgccagcagctggctgcgcttatcgacagttatcgccgtggcgagcaaccacttcttgcgccgctgatgcgtatcaaacactatatggcgctttatcctgacgcctggctttcagggcagcgttatttcgaactttggccgcgtgtgattaacttgcgccattcaggagttttatgactacccatctggtctggtttcgccaggatttacgtctgcacgataatctcgcactggctgccgcctgccgcaattcgtctgcacgcgtgctggcgttgtatatcgctacaccacgccagtgggcgacgcataacatgtcgccgcgtcaggctgaacttatcaatgctcaactgaatgggctacaaatagcgcttgcggaaaaaggtattcctttattgttccgtgaagtggatgactttgtcgccagtgtcgaaatagttaaacaggtgtgcgcggaaaacagcgttacccacctgttttataactatcagtatgaagtgaatgagcgggcgcgggatgtggaagttgaaagagcgctgcgtaacgtggtgtgtgaaggatttgatgacagcgtgatcctgccgcctggcgcggtgatgaccggtaatcacgagatgtacaaagtctttacgccttttaagaatgcctggctgaaacggctgcgggaagggatgccggagtgcgtcgctgcgccaaaagttcgtagtagcggatcgatagagccctcgccatccattacgctgaattatcctcgtcagtctttcgatactgcgcattttccggtggaagaaaaagcggcgattgcgcaattacgccagttttgccagaacggtgccggagaatatgagcaacaacgagattttccggcagtggaaggcaccagccgtttgtcggccagcctggcaacgggcgggttatcgcctcgccagtgcttgcatcgcttgttggctgaacagccgcaggcgctggacggtggggccggtagtgtctggcttaatgagctgatctggcgcgagttttaccgtcacctgataacgtatcacccctcgttgtgtaaacatcgtccatttattgcctggacggatcgtgtacagtggcagagcaatcccgcacatttacaggcctggcaggaaggcaaaacgggatacccgattgttgatgccgctatgcgtcagcttaacagcactggctggatgcataacaggctacggatgattacagccagttttctggtgaaagatttattgatcgactggcgcgaaggcgagcgatatttcatgtcgcagctgattgatggtgatttggcagccaataacggtggctggcagtgggccgcttcaaccggaaccgatgcagcgccgtattttcgtattttcaacccgacaacccagggcgagaaatttgatcatgagggcgagtttatccgccagtggctaccggaactgcgcgatgtgccagggaaagtggtgcatgagccgtggaagtgggcgcagaaagcaggtgtgacgctggattatccgcaaccgatagtcgagcacaaagaagcgagagtacaaacgttggcagcgtatgaggcggcgcggaaggggaaataacagacgcgtcaggcaatcgagcccagatgccggatgcggcgtgaacgccttatccagcctacaaatttgtgcaaattcaataaattgcaggaaatacgtaggcctgataagacgcgtcaagcgtcgcatcaggcatcggtgctggcctattaagactccagcgccagcgcgcggtttctgaatttcagcgcctgatacagccaaatcatcagtaccagtcctacacacgccagtgcgccccaggtaatttgatcaaatacttcaatatatgcattgatggagtagttgatcgccccggaagcatcaaacgaagcctgcgatgtctgatcggcaatcacgcccgccagatagttcgcgatcgcgccagaaagcagcatgtagatgccggttaatacgccggtcacaccggggatttcaatgcgcgtaatttgcgacatggcaaccgggtcgataaacagttccgcaaagcccatcaccgccaggcctaataccatcagtggcagagaagagtgaccatacattgcggaccagcgggcgcttaaggtcagaatgcagaatccggcgctcatcaggccaaggccaagagcaaatttcccccagatgcgcacggtacgattacccgcgacactctcttttaccacccacgccaggaacacaccgcacagcataactgcgaaggcattaatcgactggaacatcgcggtcggaacggtataaccaaacatatcgcggttaacgaagcggtcgatataaaggctaatcgagctaccgccctgttgtgcgaaggcccagaacaacatactgaagaaggtgagcgtcacaatcagccccagctccttccgctgtttctggttttctgctttgcgataaatttttgccagtacacccaggccaataatagtcgcgacaattaaggcgtataccgaccactctttccagaacagtatggtaatcagtgcaggcgttgccaccagcagaaccagcagccatccccagttcggcaggagaaagtttgtcgcacgcagtacttttttgttaacgccgcgggtatgagtgaaatgacgattgccacataagaaaatgaccagacccgcgatcatgccaaccgccgccaggccaaagcccatcgcccagctgtactcttcctgggcgtaaccacaggcgataggtgcgataatagaccccacgttacccgccgcatacatcagcgagaaaccgccatcacgacgcggatcggttggctcatacagctcgccgagcagacagcttacgttagatttaaacaggccatagccgcagacgataatcgccagggacagatagaggaatgacggatggatctcactggcacccagcaccacatgaccgatcgccatcaacaacgcccccagcatcaccgccatgcgattgccgagaactttatccgccaaaaagccaccgaggattggcgtgacatacaccagcgaacagtaggcgctaaataactcgtaggcgtgagtatcgttgtattttagttgattggtgagatagagaatcagcagggcacgcatgccgtaaaagctaaaatattcccagatttgcagcgcaacgacatagtaaatagcgcgcggctgtgatgcgtgtttattcataataattccacaattgacggcaacgtcacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgggtttgtttcttaatatgtcaaaagattggctatcgacgaactggcgaggtaacgctatgttaacggtgtagctatcagaatacggaaggcgcgaagatgaaaaacaccgaactggaacaactgattaacgaaaaactgaacagcgcggcgattagtgattacgcgccgaatggtttgcaggtggaaggcaaagagacggtgcaaaaaattgttaccggtgtcaccgccagccaggctttgctcgatgaggcagtgcgtctgggcgcggatgcggtcattgtgcatcatggctacttctggaaaggagagtctccggtcattcgcggaatgaagcgtaaccgtttaaaaacgttgctggcgaatgatatcaacctgtatggctggcatttgccgcttgacgcacatcctgagctgggcaataacgcacagctggcggcgttactggggatcacggtcatgggcgaaattgagccgttggtgccgtggggcgaactgaccatgcctgtgccgggactggagctggcttcctggattgaagcgcgtctgggacgtaagccgttatggtgtggcgataccggacctgaggtggtccagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcaggtcaccatgccactgaacgtggtggtattcgcgcattgagcgagtggctgaatgaaaataccgatcttgatgtgacctttattgatattcctaatcctgcataacgaataatcagagggatcgaaagtgcaacgagcgcgttgttatctgataggtgaaacggcggtagtgctggaactggaaccgccggtgacgctggctagccagaaacggatctggcgactggcgcagcgtctggtggatatgccgaatgtggttgaagccattcccggcatgaacaatatcacggtgattttgcgtaatcctgagtcgctggcgctggatgccatagagcgtttgcaacgctggtgggaggagagcgaggcgctggagccggagtctcgctttattgaaattccggtggtttacggtggtgcaggcggaccggatttggcggtggtcgcggcgcattgcgggttgagcgaaaaacaggttgttgaattgcactcctccgtggaatacgtggtctggtttttaggttttcaaccgggcttcccgtatctcgggagtttgccggaacaactacacacgccacggcgcgctgaaccgcgcttactcgttccggcaggttctgtcgggatcggcgggccgcagactggtgtttatccgctggcaacgccgggtggctggcagttgattggtcatacctcactcagcctgtttgatccggcgcgtgacgaacccatcttattacgtccgggagacagcgtgcgctttgtaccgcagaaggagggagtatgctgaagattattcgtgcgggcatgtataccactgtgcaggatggcggtcgtcacggttttcgccagtcgggtatcagccactgcggcgcactggatatgcccgcgttacgcattgctaacctactggtgggtaatgacgccaatgcccccgcgctggagatcacgctcggtcagttaactgttgagttcgaaactgatgggtggtttgctctgacgggtgccggttgcgaagcgcggctggatgataatgccgtctggaccggctggcgattgccgatgaaagcaggccagcgtttaacgcttaaacgcccgcagcacgggatgcgcagttatctggcggtcgcgggtggtattgatgttccgccggtaatgggctcatgcagcaccgatctcaaagtggggattggcgggctggaaggccgtttactgaaggatggtgaccgactcccgattggcaaatcgaagcgtgattctatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccgggcgtggtgcaggtgccacataacgggcagccgattgtgttgatgaacgacgcacagaccaccggtggttacccgcgtattgcctgtatcattgaggctgatatgtaccatctggcgcaaattccgctcggtcagccgattcattttgtccagtgttcactggaagaggcactaaaagcacggcaagatcagcaacgttattttgaacaattagcgtggcggctgcacaatgaaaattgacctgaacgccgatctgggcgaaggctgcgccagcgacgcagagctattaacgctggtttcctctgccaatattgcctgtggatttcatgcaggcgatgcgcaaatcatgcaggcttgcgtgcgtgaagcaataaaaaatggtgtcgcgattggcgctcacccgagttttcccgacagggaaaattttggtcgcagcgccatgcagctgccgccagaaaccgtttacgcccagacgctgtatcaaattggcgcgctggcaacgattgcccgtgcgcaaggcggcgtaatgcgtcatgtcaaaccgcacggcatgttgtacaaccaggcggcgaaagaagcacaactggcagacgccatcgccagagcggtatacgcttgcgatccagcattgattctcgtcgggctggcgggaagcgagctgattcgtgcaggcaagcaatatggtctgacaacgcgcgaggaagtgtttgccgatcgcggttatcaggctgacggctcgctggtgccgcgaagccagtcaggcgcgttgattgaaaacgaagaacaggcgctggcgcaaacgctggagatggtgcaacacggcagagtcaaaagtatcaccggcgaatgggcaacggtcgcggcgcaaacggtctgcctgcatggcgacggcgagcacgcactggcgttcgcccgccgactacgctctgcatttgccgaaaaggggattgttgtcgcagcataaccccgattaataaagaatgaaaaaaggatatcaccatgcctgaaggcccggagatccgccgtgcagcggataacctggaggcggcgatcaaaggcaaaccactaactgatgtctggtttgccttcccgcagttaaaaccttatcaatcacaacttatcggtcaacacgttacccatgtggaaacgcgtggtaaggcgttgttaactcatttttccaacgacttaacgctctacagccataatcagctttacggcgtctggcgcgtggttgataccggcgaagagccgcagaccacgcgagtattgcgggtaaaactgcaaacggctgacaaaaccattctgctttatagcgcctcggatattgagatgttgaccccggaacaactgaccacgcatccgtttttacaacgcgttggtcccgatgtgctggatccgaatctgacgccggaggtggtgaaagaacgattattgtcgccgcgctttcgtaaccgtcagtttgctggattactgctcgatcaggcgtttctggctgggcttggcaattatttgcgggtggagatcctctggcaggttgggttgactggaaatcataaagcgaaagatctcaatgcggcgcaactggatgcactcgcacacgcgttactggagattcctcgattttcctacgctacgcgggggcaggtggatgagaataagcatcatggggcgctgtttcgctttaaggtttttcatcgagatggcgaaccgtgcgaacgttgtggcagcatcattgagaaaaccacgctgtcatctcgcccgttttactggtgccctggctgccagcactaggccgaccgcttcggcgcataggttgaaataaaccgcgcaatggcaggccctgtcagcaaaatactgaacaggcgtagggtttgcatcgccataatgagcgccatatcggcattgctccctgcggcgatgaccgccacggtatcaagcccgccggggctggtggcgaggtaggcagtcataaaatcaatgtgcataaaccgggtcagcccccacgccatacccgcacaaatagccagcagagcaaaaatcgacagcaggatttgcggtagcgggcgtagtgcccgcagtaagatttgtttatcgaaaccaagaccaatccgccagccaattgccatatacgccatcgccagcagccattccggtagttcgatggtgatgagctgaccagactggagcactgcgcccgccagcatcgggatgagcatcgtgccggaaggaagacgcagcaggcatcccactgtaccggcaacgaccgcgagcaaaatagtaagcaggagattaatgctcactggcgggaaccagacgatatgctggttaaccgcttcagcgttatcgcccagcatcatgcgggtgaccagaacagcggcccccgcgacgaacagcactcgcagatattgcataaacgccaccaggcgaatatctgcgccgtaatcttgcgccatagcgaccattgccgccgcgccgccaggagaggagccccaggcaccggtatttccaggcaatgagctatagcgcaccaataaccaacccacaatggcgctggaaagcagcgttaccagtaaaattgcaagcacgatcggccagttgacggccagggtggtgagaatcgaaccagtgaggttttgcgcaatcatgcagccaagaatggcctgggcggcgagaaaagcagagcggggaagttgcagagtaattccgcgcatactaaagatgatcccggcgatcatcggcccaagtaatagcgccgccgggagatgtaccgcgaggaaaccaatagaaaggagaagtgatagcacacataacattccccactgcaaaactggcatccttcgctccctcattattttctctttggtgtatcgatacagcataaagaaagctgggccaggaaaaaataacagcaatcaaggaaaaggggaaaatcagcaattttctgaaagagatgccctttccggcggcaaagggcatcatggtaaatcagttatagttaatcttaaaaagcaccactgtatcgaaggggccagcctcgatgggggtgcctggaatggacgaaagttcagccgtataggttttttcgtagaccaacatgtcactggtgaaatcggcgtattcagcatatttattgaaggtataaggcgaggcgttttcatccagtaaacgtagcttcagaccattaccaatcaacaatgctttatcttcttcaaccaacgtttcttcggtataaaaggaggaactgactttaaatccgtcggtgcattgatcgttttggctcttggtcgttttaatactgaacgttttcgacattgtgtggcgacgtatatccagcaaattaaatttaccaaaatcaatcacctgtgtttccggtgaaatggaaaaattgacgctgcaatccagcacgcgaatgttttccagaccagtaatatgatatttcaggttttgggcagtagggtcttcgttaacgctaccggcaccgtcaaattgcacgacgatatagtcgctaagcgtactttgataatcatgcggcggcatttctcgtattttgacgtataaccgcatgcgagcgagaaaggtacgcgacatatgaatattagcgggatcgcccgagcaaattttgttctgccatcccatcgcgatgatctgctcaggggtataaatatcaatgttcttactgtcgatacactggttagtgtcgatgcgactttttcccagactggcatcgtaatcgacaccgttgtatgtcacgccgagttgataataacgatcctgcacccccggataggggtttacccaggcgtagacatgctcgctttcaaagttgccgttggtattgttgtcacaatagacgggaattttaatatcgtcagattcccagatcttatcaccgggtttggcattgcctggtacagcaaacggttgaatcgcttctgatttttctactgcgccaccagatgtaccaaaatagcagttcagcgccattgcagacttcaacggcagaaataacaggcagatgacgagcaacaatcccttgccagcactcatttcgcctccactgcttgtaaacggcattgtccgctgcagttgagcgtcgtcatgcgtaatgcgccgtaatcatccatgtaaccgagataaaactggctgccgctataacttccggtgtttgtgttgaccgtactaaaaggtgcaaccatcacggttttgaagcctgggagaacgcctttttcatttctccccagataggcaatggtcagataatacgcggtaggatttttcagtgtcagttggttgccctgctggctgacctgtaactgcagttcgaccttttctcctgctttcttgcgtaatgcagccggtcgccagaacaatttaatacgactttgaatagcgacctgaagtatcgcatggtcgctgcttttatccggagcgggaggaatttcgcgcatattgtagaaaaatagcgtttcgcgatcgccaggtaattgtgtggttgaggcttgtttcacaacccgcacctgcgatgtcgctttcggttccagacgttgaatagggggcaaagcgaccagaagagcatcgcttttctcccctttttcattttctatccaggaataagcaagataaggcagtttgtcactttggttttcgatacgcaggctggtggctttgtcattggcgttaaacacaatgcgtgtgcgatcgggttgcaccgcagcattgcaacccaagctgatggttaacaacattaagggtaatcctttaataaatgtcattctcttttccttaattaatgacaaggtaaaatcaggcgtttggtcgtgtcttccagacgttctggcagatgaataatgcagctttgctcaccccagaccacggtaaacagttgattttcagcgacaccgcttaaccaggcatgtccttcctcgccaaccatacccacgctaatgccgctgtcatcctggcggatatccgcaccgaggggagggaactgaccgctggcgttgcgtatgatgacgttaacgtctttaccggaacgggaagccagtgatttgtaacctatcgcgccttcaatccatgtttccttgatgacgttttctgcaactgttacgccgtcgggtaagtcattcatgttcaccgccacggtggaaggctggtaactggaaatcaacggcaccaccgcaatgccaaaatggttggtgtagtcgagattgccctgaaccggaatatctgccacgccatcggtgctgaccatcaggcgtggttcattggtggagctgcggcgatgaaatgctgcaccatattgggttgcggtgaaagaaccgctccagctgctgctgacggaactgtaatcactggcggcataggtaccagaaatatcccactcacccgctgaactcaggtgctgatagttaccgctcacctgggctccattgtccggacgatcggattgcagtccggcagacatgccccagctattacgttcatccagcgtatcgttccacgacatgcggtgtatggtgctgtggctactgttttgcatgtcatagccaacccgaccaccgttaccgaaggggagcgaaatcgacagataaatctggttgtcgcgatctttatcttcgtagtgggtcgtattgaatgacgtcgaaatcgagatatctctccagtcaccaatatcaacattaaaacctgctgtgatgttggcggtcgtggaggcgtctgcattccaccaggtttgatgtagcaggttggcgtaaagattgaggtttagtggggtaatcggttggcccacggataagctgatcgtctgtttttcgtcctgcgcatcgctgtcgttgtatttgtgatccagatagttggcgtagctgtgaaaatgacgatctgagaagcgataagcggcgagcgaaatcgtgctgttggtggcatccacttgtttgctgtaattaaaacggtagcttaagccccgctcgtcctgctgagtatcaaaatggctactggcccaggtgacatcaaaggacagtgcgccaagccacagcatattttgcccgatacccattgcggcagaatggtagtcatcatcagaaatcagcaggccgccgtacagcgaggtgtttgagagcatcccccaggaaacttcattgctaaaaaaggtttcattttcagtttgatgtgacatggaaggccgtggctgacccgcggccaatttatagcgaacctgtccctggcgagtcaggaagggcgtcgatgctgccgaaacctggaaattgttcacccgaccatcttcttccgtcactttgacatccagcgtgccctgaacagactgattgaggtcatcaataataaacgggcctggcgggacttttttctggtaaatgacgcggcctgattgactgatcgtcaccgtggcattggtctgtgcaataccgctaatttgtggggcgtagccacgcagctcccacggtaacattcgatcgtcactcgccagtgccgcgccggtataagaaaaaccatcgaaaatattggaactgaaatcggtttcgccgagggttaacttagagcctaattgcggtaatggacgaaaaagataggtgcgcgatattccgcctgactggtcatggttatcttcgctatcggtcttattaagctggtaatcactgcgtaagcgccatgccccggcgttaattccggcggtaccgtaggcattcaggttagtgctgctgctgccgtcctgtgggcggtagctgctggcaaacaagttgtaatccatcaggacaccggcaacaccttctttccatgtagaggggggagcccagttttctgagtgccacgccagccaggcttgcggaatactaatattcagttgctgattggcttgatcgaaattgaagagcatttcaggtcgggaactgaaatcaatacaccgatctatctgtggcaaggactgacggatatctggttttaaaccaaatttatcgaccagtgaatcattgatgcatggaatggttttgtcaccctttttttgccagttaattttttgcccattactgattttgttgttattcaccgcaacgctaacaaaatattcaccgggagcaatgactcctttttcctttaataatgaaatatcaatgcggtcgcgcattgatttatcgagaacattcagattgaattcgaccgccattgcgcaaggcatcgccatgaccaggcaggatacaaaagagagtcgataaatattcacggtgtccatacctgataaatattttatgaaaggcggcgatgatgccgccaaaataatacttatttataatccagcacgtaggttgcgttagcggttacttcacctgccgtgacatcgactgcattatcaatttgttccatccaggcgaaaaagttcagcgtctgttctgatgagcttgcatccaggtcaagatctggcgcggctgaacctaatacgatgttaccgtcatttttgtccatcagtcgtacaccgaccccagttgcttcgcctgcactggtgttgctcaacaaaggcgtagcaccagttgtcttagccgtgctatcgaaggttacgccaactttggataccggcattccgctaccgttgtcagaagcaggcagatcacagttgatcaagcgaatgtcgacggccactttattgctatgatgctcccggtttatatgggttgtcgtgacttgtccaagatctatgtttttatcaatatcttctggatgaatttcacaaggtgcttcaataacctcccccttaaagtgaatttcgccagaaccttcatcagcagcataaacaggtgcagtgaacagcagagatacggccagtgcggccaatgttttttgtcctttaaacataacagagtcctttaaggatatagaataggggtatagctacgccagaatatcgtatttgattattgctagtttttagttttgcttaaaaatattgttagttttattaaatgcaaaactaaattattggtatcatgaatttgttgtatgatgaataaaatataggggggtatagatagacgtcattttcatagggttataaatgcgactaccatgaagtttttaattgaaagtattgggttgctgataatttgagctgttctattctttttaaatatctatataggtctgttaatggattttatttttacaattttttgtgtttaggcatataaaaatcaacccgccatatgaacggcgggttaaaatatttacaacttagcaatcaaccattaacgcttgatatcgcttttaaagtcgcgtttttcatatcctgtatacagctgacgcggacgggcaatcttcataccgtcactgtgcatttcgctccagtgggcgatccagccaacggtacgtgccattgcgaaaatgacggtgaacatggaagacggaatacccatcgctttcaggatgataccagagtagaaatcgacgttcgggtacagtttcttctcgataaagtacgggtcgttcagcgcgatgttttccagctccatagccacttccagcaggtcatccttcgtgcccagctctttcagcacttcatggcaggtttcacgcattacggtggcgcgcgggtcgtaatttttgtacacgcggtgaccgaagcccatcaggcggaaagaatcatttttgtctttcgcacgacgaacaaattccggaatgtgtttaacggagctgatttcttccagcattttcagcgccgcttcgttagcaccgccgtgcgcaggtccccacagtgaagcaatacctgctgcgatacaggcaaacgggttcgcacccgaagagccagcggtacgcacggtggaggtagaggcgttctgttcatggtcagcgtgcaggatcagaatacggtccatagcacgttccagaatcggattaacttcatacggttcgcacggcgtggagaacatcatattcaggaagttaccggcgtaggagagatcgttgcgcgggtaaacaaatggctgaccaatggaatacttgtaacacatcgcggccatggtcggcattttcgacagcaggcggaacgcggcaatttcacggtgacgaggattgttaacatccagcgagtcgtgatagaacgccgccagcgcgccggtaataccacacatgactgccattggatgcgagtcgcgacggaaagcatggaacagacgggtaatctgctcgtggatcatggtatgacgggtcaccgtagttttaaattcgtcatactgttcctgagtcggtttttcaccattcagcaggatgtaacaaacttccaggtagttagaatcggtcgccagctgatcgatcgggaaaccgcggtgcagcaaaataccttcatcaccatcaataaaagtaattttagattcgcaggatgcggttgaagtgaagcctgggtcaaaggtgaacacaccttttgaaccgagagtacggatatcaataacatcttgacccagcgtgcctttcagcacatccagttcaacagctgtatccccgttgagggtgagttttgcttttgtatcagccatttaaggtctccttagcgccttattgcgtaagactgccggaacttaaatttgccttcgcacatcaacctggctttacccgttttttatttggctcgccgctctgtgaaagaggggaaaacctgggtacagagctctgggcgcttgcaggtaaaggatccattgatgacgaataaatggcgaatcaagtacttagcaatccgaattattaaacttgtctaccactaataactgtcccgaatgaattggtcaatacttccacactgttacataagttaatcttaggtgaaataccgacttcataacttttacgcattatatgcttttcctggtaatgtttgtaacaactttgttgaatgattgtcaaattagatgattaaaaattaaataaatgttgttatcgtgacctggatcactgttcaggataaaacccgacaaactatatgtaggttaattgtaatgattttgtgaacagcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctccaggtaacagaaagttaacctctgtgcccgtagtccccagggaataataagaacagcatgtgggcgttattcatgataagaaatgtgaaaaaacaaagacctgttaatctggacctacagaccatccggttccccatcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcgtatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaagcaacgcctccgcattaggacgcaatggcgtacatgatttcatcctcgttcgcgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggctttgcgcctgatgctgcaactggtgattgtcgttgcactggtggtttacgtgatttatggattcgttgtggtgtggggtgtgtgatgaaattgccagtcagagaatttgatgcagttgtgattggtgccggtggcgcaggtatgcgcgcggcgctgcaaatttcccagagcggccagacctgtgcgctgctctctaaagtcttcccgacccgttcccataccgtttctgcgcaaggcggcattaccgttgcgctgggtaatacccatgaagataactgggaatggcatatgtacgacaccgtgaaagggtcggactatatcggtgaccaggacgcgattgaatatatgtgtaaaaccgggccggaagcgattctggaactcgaacacatgggcctgccgttctcgcgtctcgatgatggtcgtatctatcaacgtccgtttggcggtcagtcgaaaaacttcggcggcgagcaggcggcacgcactgcggcagcagctgaccgtaccggtcacgcactgttgcacacgctttatcagcagaacctgaaaaaccacaccaccattttctccgagtggtatgcgctggatctggtgaaaaaccaggatggcgcggtggtgggttgtaccgcactgtgcatcgaaaccggtgaagtggtttatttcaaagcccgcgctaccgtgctggcgactggcggagcagggcgtatttatcagtccaccaccaacgcccacattaacaccggcgacggtgtcggcatggctatccgtgccggcgtaccggtgcaggatatggaaatgtggcagttccacccgaccggcattgccggtgcgggcgtactggtcaccgaaggttgccgtggtgaaggcggttatctgctgaacaaacatggcgaacgttttatggagcgttatgcgccgaacgccaaagacctggcgggccgtgacgtggttgcgcgttccatcatgatcgaaatccgtgaaggtcgcggctgtgatggtccgtgggggccacacgcgaaactgaaactcgatcacctgggtaaagaagttctcgaatcccgtctgccgggtatcctggagctttcccgtaccttcgctcacgtcgatccggtgaaagagccgattccggttatcccaacctgtcactacatgatgggcggtattccgaccaaagttaccggtcaggcactgactgtgaatgagaaaggcgaagatgtggttgttccgggactgtttgccgttggtgaaatcgcttgtgtatcggtacacggcgctaaccgtctgggcggcaactcgctgctggacctggtggtctttggtcgcgcggcaggtctgcatctgcaagagtctatcgccgagcagggcgcactgcgcgatgccagcgagtctgatgttgaagcgtctctggatcgcctgaaccgctggaacaataatcgtaacggtgaagatccggtggcgatccgtaaagcgctgcaagaatgtatgcagcataacttctcggtcttccgtgaaggtgatgcgatggcgaaagggcttgagcagttgaaagtgatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggatgaaggtcgcgacatgatgctgctggatgcgcttatccagctaaaagagaaagatcccagcctgtcgttccgccgctcctgccgtgaaggtgtgtgcggttccgacggtctgaacatgaacggcaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggctgtatgaatgtattctctgcgcatgttgttcaacctcttgtccgtctttctggtggaatcccgataagtttatcggcccggcaggcttgttagcggcatatcgtttcctgattgatagccgtgataccgagactgacagccgcctcgacggtttgagtgatgcattcagcgtattccgctgtcacagcatcatgaactgcgtcagtgtatgtccgaaggggctgaacccgacgcgcgccatcggccatatcaagtcgatgttgttgcaacgtaatgcgtaaaccgtaggcctgataagacgcgcaagcgtcgcatcaggcaaccagtgccggatgcggcgtgaacgccttatccggcctacaagtcattacccgtaggcctgataagcgcagcgcatcaggcgtaacaaagaaatgcaggaaatctttaaaaactgcccctgacactaagacagtttttaaaggttccttcgcgagccactacgtagacaagagctcgcaagtgaaccccggcacgcacatcactgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacattaccagcaccgaagaaaaacgctggatccaacagcgtatcgagtctggtcgcgcgactttcaatagcgaagagaaaaaacgcttcttaagcgaactgaccgccgctgaaggtcttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggtttcaccacctctaatccgctggatgcccgttctacgccgtactgtactgatatcggtaagatggttcaggccccgattttccacgttaacgcggacgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacaccgcgcaaaatctacgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtacctcaaccacgaatgggacgaagagtacccgaacaaagttgagatgaagcgcctgcaggagctggcgaaacgcatcagcacggtgccggaagcagttgaaatgcagtctcgcgttgccaagatttatggcgatcgccaggcgatggctgccggtgagaaactgttcgactggggcggtgcggaaaacctcgcttacgccacgctggttgatgaaggcattccggttcgcctgtcgggtgaagactccggtcgcggtaccttcttccaccgccacgcggtgatccacaaccagtctaacggttccacttacacgccgctgcaacatatccataacgggcagggcgcgttccgtgtctgggactccgtactgtctgaagaagcagtgctggcgtttgaatatggttatgccaccgcagaaccacgcactctgaccatctgggaagcgcagttcggtgacttcgccaacggtgcgcaggtggttatcgaccagttcatctcctctggcgaacagaaatggggccggatgtgtggtctggtgatgttgctgccgcacggttacgaagggcaggggccggagcactcctccgcgcgtctggaacgttatctgcaactttgtgctgagcaaaacatgcaggtttgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggcgtgaagcgcgtagtgatgtgttctggtaaggtttattacgacctgctggaacagcgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataaataaaggatacacaatgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgccggtaaagaaaccagcgccaaatctgaagagaaagcgtccactccggcgcaacgccagcaggcgtctctggaagagcaaaacaacgatgcgttaagcccggcgatccgtcgcctgctggctgaacacaatctcgacgccagcgccattaaaggcaccggtgtgggtggtcgtctgactcgtgaagatgtggaaaaacatctggcgaaagccccggcgaaagagtctgctccggcagcggctgctccggcggcgcaaccggctctggctgcacgtagtgaaaaacgtgtcccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaacgcttctatcgacggcgatgacgtggtttaccacaactatttcgacgtcagcatggcggtttctacgccgcgcggcctggtgacgccggttctgcgtgatgtcgataccctcggcatggcagacatcgagaagaaaatcaaagagctggcagtcaaaggccgtgacggcaagctgaccgttgaagatctgaccggtggtaacttcaccatcaccaacggtggtgtgttcggttccctgatgtctacgccgatcatcaacccgccgcagagcgcaattctgggtatgcacgctatcaaagatcgtccgatggcggtgaatggtcaggttgagatcctgccgatgatgtacctggcgctgtcctacgatcaccgtctgatcgatggtcgcgaatccgtgggcttcctggtaacgatcaaagagttgctggaagatccgacgcgtctgctgctggacgtgtagtagtttaagtttcacctgcactgtagaccggataaggcattatcgccttctccggcaattgaagcctgatgcgacgctgacgcgtcttatcaggcctacgggaccaccaatgtaggtcggataaggcgcaagcgccgcatccgacaagcgatgcctgatgtgacgtttaacgtgtcttatcaggcctacgggtgaccgacaatgcccggaagcgatacgaaatattcggtctacggtttaaaagataacgattactgaaggatggacagaacacatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataatgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataaatatctgtaataagaaatagccctcgccgcttccctctacaggaatggcgaagggctgtcggtttcgacatggttggccatcgtatgatggccttttttgtgcttatcgcgatgattttcgctgcgctatcagggtaaatttatagtcatcggtattaaaagcgttgcggctatattcaaacacccgaccatcaactaaatatccacgcgatactttttcaagaatcggctttgtctggctgatattaagcagacggctcatctcttcggttggcatcagaggaatgatttcctgttcgctacgatcgataaccattttcttcacttcttcgataaagtgatatttcgaattttccatgacctgccaggtgagatccgggaacaacgcaagcggcatccaggtttcttccagcgccattggcttttgcttgcgatagcgcacgcgcttcacatgccacacacgatcctgcggggtgatttgtagctgttgctgaagaaaatcgtcagccggaatcacttcgaatatcagaacttcactgtgtgtatcgacgtgacggtccgacagtttttcatcaaaactggttaactgaaaaatatcgtaattgacccgctcttctttgacgtaagtcccgctgccctgaatgctttcgaggatctgctgctcgactagctggcgcaaagcctgacgcaccgtaacccggctgacgccaaactctgtttgtagcgctgattcagtgggtaacgcatcgccaggtttaagctcgccacgcgcaatttgttcacgaatgcgatcggcaatctgccggtataagggcttgtgtcccatttttagtatctcattaatacgaatttaaccattatgcccgataaattcatcctgtaaataatacaaatacaatacaaataatttcaatcaagtgaaattgatcacataatggtattgttttatcgggcacactggcgcgactataaaaacgatcaagtgaggatcatgatgaatctgacgactctgacccaccgcgatgcgttgtgtctgaatgcgcgctttaccagccgtgaagaggccatccacgcgttgactcaacgtcttgctgctctggggaaaatttccagtactgagcaatttctggaagaagtgtatcgccgtgaaagccttggcccgaccgccttaggtgaagggttggctgtgccgcatggcaaaactgctgcggtaaaagaagcggcgtttgcggtcgccacactcagcgagccgcttcagtgggaaggcgttgatggcccggaagcagttgatttagtggtgctgctggcgattccccccaatgaagcgggtactacgcatatgcaactgctgacagcgctgaccacgcgccttgcggatgatgagattcgggcgcgtatacagtcggcgacgacgcctgatgagttgctctcggcgctggatgacaagggaggcacgcaaccttctgcctctttttccaacgcgccaactatcgtctgcgtaacggcctgtccggcgggtattgctcacacctatatggctgcggaatatctggaaaaagccggacgcaaactcggcgtaaatgtttacgttgaaaaacaaggcgctaacggcattgaagggcgtttaacggcggatcaactcaatagtgcaaccgcctgtatttttgcggctgaagtcgccatcaaggagagtgagcgttttaatggcattcccgcgctttcagtgcctgttgccgagccgattcgccatgcagaagcgttgatccaacaagcgcttaccctcaagcgtagcgatgagacgcgtaccgtacagcaagatacgcaaccggtgaaaagtgtcaaaacggagctgaaacaggcactgttgagcggaatctcttttgccgtaccgttgattgtcgcggggggcacggtgctggcggtcgcggtattactgtcgcaaatcttcgggctacaagatctgtttaatgaagaaaactcctggctgtggatgtaccgcaagctgggcggcgggctgctcggaattttgatggtaccggtgctcgcggcctataccgcctattctctggcagataaaccggcgttagcgccaggctttgcggctggacttgccgccaacatgatcggctccgggtttctcggcgcggtcgttggcggattgatagccggttacttgatgcgctgggtgaaaaatcacttgcgtcttagcagtaaattcaatggattcctgactttttatctctacccggtgctcggtacgttgggagcgggcagtctgatgctgtttgtggtgggggaacctgtcgcctggatcaataactcgcttaccgcctggctgaacggtctgtcaggaagtaacgcgctgttgctgggtgccattctcggttttatgtgttcctttgaccttggagggccagtgaataaagccgcttatgcattctgcctgggcgcaatggcgaacggcgtttacggcccgtatgccattttcgcctccgtcaaaatggtttcggcatttaccgtaaccgcttccacgatgctcgcaccgcgcctgtttaaagagtttgaaattgagaccgggaaatccacctggctgttagggctggcaggtattaccgaaggggcgatcccgatggcgattgaagatccgctgcgggttattggttcgtttgtgctgggctctatggtaacgggcgctattgtcggtgcgatgaatatcggcctttcgacacccggtgccggcattttctcgctctttttacttcatgataatggcgcgggcggtgttatggcggcaattggctggtttggcgcggcattggtgggggctgcaatctcgactgcaattctcctgatgtggcggcgtcacgcggttaagcatggcaactatctgactgatggcgtaatgccataaacaaaaaggaaacgacgatgaaagcagtatctcgcgttcacatcaccccgcatatgcactgggatcgagagtggtatttcaccaccgaagagtcacgtattctgctggtcaataatatggaagagatcctgtgccgactggaacaggacaacgaatacaaatattacgtactcgacgggcaaacggcgatcctcgaagattatttcgcggtgaaaccggaaaacaaagaccgtgtgaagaaacaggtagaagccggcaagttgattatcggcccctggtatacccagaccgataccacgattgtttctgcggaatccatcgtccgtaatctgatgtacggaatgcgtgactgcctcgcgtttggcgagccgatgaaaataggttatttaccagattcctttggcatgtccgggcaactgccgcatatctacaatggatttggcattacccgcaccatgttctggcgcggatgttcggagcgccacggtactgataaaaccgagtttttgtggcaaagcagtgacggtagcgaagtgacggcgcaggtgctgccgctgggctacgccatcggtaagtacttacctgccgacgaaaacggattacgtaaacgcctcgacagttattttgacgtgctggaaaaagcgtctgtaaccaaagagattttgctgccgaatgggcatgaccagatgccattgcagcaaaatatcttcgaagtgatggataagctacgtgagatctaccctcaacgtaagtttgtgatgagccgctttgaagaggtatttgagaagatcgaagcgcagcgagataatctggcaaccctgaaaggggaatttattgatggcaaatatatgcgcgtgcatcgcaccatcggttctacgcgtatggatatcaaaattgcccacgcgcgtattgaaaataagattgttaatctgctggaaccgctggcaacactggcctggacgttgggttttgaataccaccacggcttgctggagaaaatgtggaaagagatcttaaaaaatcatgcccacgacagtatcggctgctgctgtagtgacaaagttcatcgcgaaatcgtcgcccgcttcgaactggctgaagacatggcggataatctgattcgtttctacatgcgcaaaattgccgacaacatgccgcagagcgacgccgacaaactcgtcctgtttaacctgatgccctggccgcgtgaagaagttatcaacaccactgtgcggctgcgcgccagccagtttaatttgcgggacgatcgcggtcagcctgtaccgtattttattcgccatgcccgtgagatcgatccaggcctaatcgatcggcaaatagttcattacggtaattacgatccctttatggagtttgatatacagatcaaccagattgtcccttctatgggctatcgcacgctttatatcgaagcgaatcagcctggcaacgtaattgcggcaaaaagtgacgctgaagggatactggaaaatgctttctggcaaattgcgctcaatgaggatggttctctgcaactggtagataaagacagcggtgtgcgctatgaccgggtattgcaaattgaagaaagctctgatgatggtgatgaatatgactattcacccgcaaaagaagagtgggtaattaccgcagcgaacgcgaaaccgcaatgcgatattattcatgaagcctggcagagcagggctgttatccgctatgacatggcagtgccgctcaatttgtcagaacgcagcgcccggcaatccactggcagagtaggggtggtgttggttgtcactcttagtcataacagcaggcgtattgatgtggatatcaatcttgataaccaggctgacgatcatcgccttcgtgtcctggtccctacaccttttaacaccgacagtgttctggcagatacgcagtttggttcgctaacgcgccccgtgaacgacagtgcaatgaacaactggcagcaagaaggctggaaagaagcgccggttccggtatggaatatgctcaactatgttgccttacaggaagggcgtaacggcatggctgtctttagcgaagggttacgtgaatttgaagtcatcggtgaagagaagaaaacctttgccattacgttgctgcgtggcgtgggcttactgggcaaagaagatctgcttttaaggcctgggcggccttcgggaattaaaatgccagtcccggactcacaactacgtggtctgctttcttgtcgcctaagtttattgagttataccggtacgccaaccgccgctggtgtagctcagcaggcgcgagcatggctgactccagtacagtgttacaacaaaatcccatgggatgtgatgaagctcaacaaagccggattcaacgtgccggaaagttatagtttgttgaaaatgcccccagtgggatgcctgataagcgcacttaagaaagctgaagaccgacaagaagtgattttacggctgtttaatccggctgaatcagcaacctgtgatgcgactgttgctttcagtcgcgaggtgatttcttgctcagaaacgatgatggatgaacacattaccaccgaggaaaatcaaggttcaaatctatcggggccttttttacccggccagtcacggacgttcagttaccggcttgcctgaatagcaatcaaaccgaagccacatatgcgcggccagattgttgacaaagggcgctttgttcatgccggatacggcatgaacgctttattcggtctacaaaagcaggcaaattcaatatattgcagagatgatgtagacactggcaagcgtagcgcatcaggtaattttgcgtttatcttcactctcaagccacgtatatgtggctttatttttaacaaaataataaccctgggtgagttaattataatataattataagttaactaaatgttaatattggcggggtggatttatgcctttattagtaatcctgaaactctgcgtcgtattagccagtgaccaaaaaaagaattaaggtcaaccgtgctgtttttgcttcgtctctttttatctttaattgccaaccgaaactaatttcagccttataactcacacattttaaacataaatgtcactaaagttaccttattgaaacatgattaacataatttgtaggaattgatatttatcaatgtataagtcttggaaatgggcatcaaaaagagataaattgttctcgatcaaattggctgaaaggcggtaatttagctataaattgatcaccgtcgaaaaatgcaaatttgcttcaacaaaaacctgtttattgtaaggattttgcggcgtaatatatacgtgggatcaatttgagtttttattaacatgtttgcaacctttctttacgccgtttttgtgtgcattcacatggtatgatgaaagtgttcaaacaaatttctattggggcatgcgtgtgaccctttctaacggggttcactctcggagtcttcatgcgatgagcaaggagtcatgatgttagatatagtcgaactgtcgcgcttacagtttgccttgaccgcgatgtaccacttcctttttgtgccactgacgctcggtatggcgttcctgctggccattatggaaacggtctacgtcctctccggcaaacagatttataaagatatgaccaagttctggggcaagttgtttggtatcaacttcgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcgaacggctggatgcaaaacccaatcgcgtccgatttcaactttgaaactatgcgtatggagatggtgagcttctccgagctggtgcttaacccggttgctcaggtgaaattcgttcacactgtagcgtctggttatgtgactggcgcgatgttcatcctcggtatcagcgcatggtatatgctgaaaggtcgtgacttcgccttcgctaaacgctcctttgctatcgctgccagcttcggtatggctgctgttctgtctgttattgttctgggtgatgaatccggctacgaaatgggcgacgtgcagaaaaccaaactggctgctattgaagccgagtgggaaacgcaacctgcgcctgctgcctttactctgttcggcattcctgatcaggaagaggagacgaacaaatttgcgattcagatcccttacgcactgggcatcattgcaacgcgttccgtggataccccggttatcggcctgaaagagctgatggtgcagcatgaagaacgcattcgtaacgggatgaaggcgtactctctgctcgaacaactgcgttctggttctaccgaccaggcggttcgtgaccagttcaatagcatgaagaaagacctcggttacggtctgctgctgaaacgctatacgccaaacgtggctgatgcgactgaagcgcagattcaacaggcaaccaaagactccatcccgcgtgtagcgccgctgtactttgcgttccgtatcatggtggcgtgtggcttcctgcttctggcaatcatcgcgctctctttctggagtgtcatccgcaaccgcattggcgagaaaaaatggcttctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcaatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaagacaggagtcgtcaaatgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccattgcaccacactgggacggtaaccaggtttggctgatcaccgcgggcggcgcactctttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtaattggtgtagcgttcggtaacctgttgcagggcgtaccgttcaacgttgatgaatatctgcgtctgtactacaccggtaacttcttccagttgcttaacccgttcggcctgctggcaggcgtggtgagcgtagggatgatcattactcagggcgcaacctatctgcaaatgcgtaccgtgggcgaactgcacctgcgtacccgtgcaacggctcaggtggctgcgctggtgacactggtctgtttcgcactggctggcgtatgggtgatgtacggtatcgatggttatgtcgtgaaatcgacaatggaccattacgcagcctctaacccactgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtgttctcctccctgacgctggcctgcatcatcctgacagccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaagtaaggagctaaaaatgtggtatttcgcatggattctgggaacgcttcttgcctgttcgtttggggtaatcaccgcgctggcgcttgaacacgtcgaatcaggcaaagccggtcaagaagacatctgatgagtaagattatcgcgactttgtatgcggtaatggacaagcgccccctgcgggcgctttccttcgtgatggcgcttctgttagcaggatgtatgttttgggacccatctcgttttgccgcgaagaccagtgaactggaaatctggcatggtttattgctgatgtgggccgtctgtgctggtgtgattcacggcgtgggctttcgtccgcagaaggttctttggcaagggattttttgcccattgcttgccgatattgttctcattgtcgggctgattttcttcttcttttaaatcagaattctctttaaaaaattatgggccgctccaggcccataaatttttacgctcccttaacttgccctcattcccaaacctcaatcgcgcgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcacttcagtcagcaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgctgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcttgggccattattatccagcggacccgtattcttaacgcagcggcgcgcgaagccgaagcgtttgaagataaattctggtctggaatcgaactctctcgcctctatcaagagagccaggggaaacgggataatctgactggttcggaacaaatcttttacagcgggttcaaagagtttgtgcgcctgcatcgtgccaatagccatgcgccggaagccgtagtggaaggggcgtcgcgtgctatgcgtatctccatgaaccgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgactgcaattggtctgtttgccgctatcccggcagttatggcctacaaccgcctcaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgcctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgcatgcaaagccaggaatcaagcgcgaagcgttctgatgaacagcgcaagatgaaggaacagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagctgaagaggcggcagcgaaagcggcggcagatgctaaagcgaaggccgaagcagatgctaaagctgcggaagaagcagcgaagaaagcggctgcagacgcaaagaaaaaagcagaagcagaagccgccaaagccgcagccgaagcgcagaaaaaagccgaggcagccgctgcggcactgaagaagaaagcggaagcggcagaagcagctgcagctgaagcaagaaagaaagcggcaactgaagctgctgaaaaagccaaagcagaagctgagaagaaagcggctgctgaaaaggctgcagctgataagaaagcggcagcagagaaagctgcagccgacaaaaaagcagcagaaaaagcggctgctgaaaaggcagcagctgataagaaagcagcggcagaaaaagccgccgcagacaaaaaagcggcagcggcaaaagctgcagctgaaaaagccgctgcagcaaaagcggccgcagaggcagatgatattttcggtgagctaagctctggtaagaatgcaccgaaaacggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaggctgcgttggcagcagctaaacttgcgaagatcccgaaaccaccaagccaggcagtatatgaagtgttcaaaaacgcgccattggacttcaaaccgtaatcgcgatgttgactgttcggacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgcgctcgtctgccacagcagccgggtagtgcgcaggaagtacaaccagctgcatggtccgcactgggcattgacgctgtagttgtcggtcaggtcactccgaatccggatggttcttacaatgttgcttatcaacttgttgacactggcggcgcaccgggtactgtacttgctcagaactcgtacaaagtgaacaagcagtggctgcgttatgctggtcataccgccagtgatgaagtgtttgaaaaactgaccggcattaaaggtgcgttccgtactcgtattgcctacgttgttcagaccaacggcggtcagttcccgtatgaactgcgcgtatctgactatgacggttacaaccagtttgtcgttcaccgttcaccgcagccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagtctgaacctgtacgtaatggatttggcttctggtcagatccgccaggtgactgatggtcgcagtaacaataccgaaccgacctggttcccggatagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaatggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacatgcaaacttcctgcgtagcaacccgtcttacaaagtcaccgtagaaggtcacgcggacgaacgtggtactccggaatacaacatctccctgggtgaacgtcgtgcgaacgccgttaagatgtacctgcagggtaaaggcgtttctgcagaccagatctccatcgtttcttacggtaaagaaaaacctgcagtactgggtcatgacgaagcggcatactccaaaaaccgtcgtgcggtactggtttactaagagaattgcatgagcagtaacttcagacatcaactattgagtctgtcgttactggttggtatagcggccccctgggccgcttttgctcaggcaccaatcagtagtgtcggctcaggctcggtcgaagaccgcgtcactcaacttgagcgtatttctaatgctcacagccagcttttaacccaactccagcaacaactttctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcggcgatcaaagcggtgcggcggcatcaacgacgccgacagctgatgctggtactgcgaatgctggcgcgccggtgaaaagcggtaatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtactattttgcttcggtagtgaaaaactatccgaagtcaccaaaggctgcagatgcgatgtttaaagtcggcgtcatcatgcaggacaaaggtgacaccgcaaaagcgaaagccgtataccagcaggttatcagtaaataccctggtactgatggcgctaaacaggcacaaaaacgtctgaacgcgatgtaatgcataacacacgaccagaagtcgcattatttctggtcgtgtcgtgcgaatcataagcagttgagtgatctacatcgaaatttttgttgcgctcaagtctgaaatcagtaatatatgccgccgttgccacgggatatcaaacaaaccgaaagcaacgaaaaagtgggtcgttagctcagttggtagagcagttgacttttaatcaattggtcgcaggttcgaatcctgcacgacccaccaatcgctaaggtggaagcggtagtaaaacgtgaaggataacgttgcatgagcaacggcccgaagggcgagacgaagtcgagtcatcctgcacgacccaccactaacatagttagttgtagtatccagcgtagtatcgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccagttttaacatcgaagacagatgttaagcgtgtaggataacgttgcgtcagcaacggcccgtagggcgagcgaagcgagtcatcctgcacgacccaccactaatgacggtgggttcggtggaagtagtttgtagtatccagcgcagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccagttttaacatcaaactcagatgttaagcgtgaaggataacgttgcgccagcaacggcccgtagggcgagcgaagcgagtcatcctgcacgacccaccaatcttaaagattggccccgagtaaaaatctttcaggtaacacccgtatgggtcgttagctcagttggtagagcagttgacttttaatcaattggtcgcaggttcgaatcctgcacgacccaccaatttaaaggtggttactggtagagaacgtgaaggataacgttgcgttagcaacggcccgaagggcgagacgaagtcgagtcatcctgcacgacccaccatcctgaatgattaaggcagcataatcccgcaaggggtcgttagctcagttggtagagcagttgacttttaatcaattggtcgcaggttcgaatcctgcacgacccaccaatgtaaaaaagcgccctaaaggcgcttttttgctatctgcgatactcaaagattcgaacctgcagcaggtttgagttgagcgcagcgaaacaacggagccgctcgcggcgacggcccgaagggcgagcgaagcgagtcatcctgcacgacccaccaatgtaaaaaagcgccctaaaggcgcttttttgctattcaggcatcctcaatttcactttgtaaacctgatgacatcgtcagagcttactgtgcaagcaactctatgtcggtggaattaggcgtaaaatgacgcatcctgcacattaggcgtaattcgagtgacttttccccaccattcgactatcttgtttagcatataaaacaaattacaccgataacagcgaatattacgctaatgtcggttttaacgttaagcctgtaaaacgagatggtaagatgagcgtaatgtttgatccagacacggcgatttatcctttccccccgaagccgacgccgttaagcattgatgaaaaagcgtattaccgcgagaagataaaacgtctgctaaaagaacgtaatgcggtgatggttgcccactactataccgatcccgaaattcaacaactggcagaagaaaccggtggctgtatttctgattctctggaaatggcgcgcttcggtgcaaagcatcccgcttctactttgttagtcgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatcttgatagtttgggtgaaaaaatcatctgggcacccgacaaacatctggggcgttacgtgcaaaaacagacgggtggagacattctatgctggcagggtgcctgtattgtgcatgatgaatttaagactcaggcgttaacccgcttgcaagaagaatacccggatgctgccatactggtgcatccagaatcaccacaagctattgtcgatatggcggatgcggtcggttccaccagtcaactgatcgctgctgcgaaaacattgccacatcagaggcttattgtggcaaccgatcggggtattttctacaaaatgcagcaggcggtgccagataaagagttactggaagcaccaaccgcaggtgagggtgcaacctgccgcagctgcgcgcattgtccgtggatggccatgaatggccttcaggccatcgcagaggcattagaacaggaaggaagcaatcacgaggttcatgttgatgaaaggctgcgagagagggcgctggtgccgctcaatcgtatgctggattttgcggctacactacgtggataacgaataataaggcgtaacgttacgctttgggggaaagatggatttttttagtgtgcagaatatcctggtacatataccaataggggcaggcggttatgatctctcatggatcgaagcggtaggcacgatcgccgggttgctgtgtattggccttgccagtctggagaagatcagcaactacttctttggcctgatcaacgtcaccttgtttggcattattttctttcagattcagctgtatgccagcctgctattacaggtgtttttctttgccgcgaatatttacggttggtatgcgtggtcgcgacaaaccagtcagaacgaggcggagttgaaaattcgctggttgccattgccgaaggcactcagctggttggcggtttgcgttgtttcgattggtctgatgacggtatttatcaatccggtgtttgcatttttgacccgcgtggcagtcatgatcatgcaagcattaggattacaggttgtgatgcctgaactgcaaccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgcgctcaacggcagccggatgtggatcaacagcgcacgtgaaagaggctcacgcgcgctgtcccattaatggtgatgatgtgaatggccagacaccccttcattcaggtggcagtctggcccatgacaaggttgatattccatctgaatggtggcgtgctcaatctgatagtgatccatcaggtagtgttggatctgatccaacaaggcatcgtgatcgtgtggcgggatcacctgcacatgcaacgtcatcaccggcttctcgcctaccatccatacatgtacatggtgcacattgcggacttccgggatttcccggcacatacgacgcttcagttcagcgatatccagcgataccggtgcaccttcaagtaattcattcacgctatctttcaacagtcgccacgcgctacgcagaaccagaagcgacaccagtatcgagagaatggggtcagcaggtgtccagccagtccagataataatcaacgcggcaataatagccccaaccgaacccagcaggtccccgagcacatgcagtgccgctgctcgtacgttgaggtttttctcttcgctgccgtgatgaagtaaccagaaagaaagtatatttgccagcaacccagccacggcaattgccatcatcatgccgccctcgaccggacgcggcgtgcggaagcgttctatcgcctcccagacaatcaaaatggtaattaccacgagggctatggcattcacaaacgccgcgagcgtggtcagtcttagccaaccgaaagtgtggcgaatggtgggaggacgacgtgaaaattgcacggcgagtagggcgaaaagcagggcggcagtatcggtcaacatatgacccgcatcggccagcaatgccagagaaccagaaagaaaaccaccaacgacttctaccagcataaacccggcagtcacgccgaaagcatacaacaagcgacgagcattattatcttctggcaggtgtgaggacgtgtgtgagtgtgagtgcgccatgacgagtcatcccttaattattctcacttaactttatgacatcatactgcttttagaagtgaaaaattaaaagggagagactccgctctcccattattggctattttgcagggttactgcgtggtaccgtcggttttggtatcgacatcattattgatgccatcaccggtttgtacctttttattgatatccggacagcgaccatctttgcacatggtgttcttgtgctcttcatctttggtcattccgtcattgttcattgaagaaccatccgaatgcagcattgtgccgccagaaccggtatttaccccgttattgtcgacgttatttggcgcgacattttcacgggcgtcaggggctacctggcccgcatcagctgcggcgtttgcctggccgttattagtttgcgctccgctatcggcagccagtgcggcaccgctggcaaggcttagagtggcagtcagaaataatgtggccagttttgtcattttcataggatgctcctgttatggtcgttatgtcggataacctcttccaacagtgcatttgcaggtgaatataaggcattggtttaagatttcagccaggttatgaaacgcagcagagaatcttgaaataattaacaaacaaaggagttacagttagaaattgtaggagagatctcgtttttcgcgacaatctggcgtttttcttgctaattccaggattaatccgttcatagtgtaaaaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaaggtttaattgtcggatgcgccgtcagagtggcgtatccgatgaatcaccacaggcctgataagtcgcgcagcgtcgcatcaggcaatgtgctccattgttagcaacaaaaaagccgactcacttgcagtcggctttctcattttaaacgaatgacgtttacttcgctttaccctggtttgcaaccgccgctgctttcgctgcgatctcgtcagcattacccagataatagcgtttcagcggtttgaaattctcgtcgaactcatacaccagcggcacgccagtcgggatattaagctcaagaatctcttcttcgctcatgttatcaagatatttcaccagcgcacgtaaagagttaccgtgtgcagcgatgatcacgcgctcaccgctcttcatacgcggcagaatagtttcattccagtaagggatcacgcggtcaatggtcagcgccaggctttccgtcagcggcagttctttctcgctcagtttcgcgtaacgcggatcgtgacccggataacgctcatcatctttagtcagttccggcggagtcactgcaaaaccacgacgccactgtttcacctgctcgtcgccatacttttcagcagtttccgctttgttcagaccctgcaacgcaccgtagtgacgttcgttcagtttccaggatttctcaacgggcagccatgcctgatccagttcgtccagcacattccacagggtatggatagcgcgtttcagcacagaagtgtaagcaaagtcaaagctgtaaccttcctctttcagcagcttacctgctgcttttgcttcgcttacgcctttctcagacagatccacgtcgtaccaaccggtgaaacggttttctttgttccactgactttcgccatgacgaaccagaaccagcttagttacagccatatacttactcctcaaatcatcttttaatgataataattctcattatattgccgcgacgaagcaacagcaatgcttacgcataaccatagcgaaaatagtggcgcagtgtaaggttgttgtgaatattgagttgcaaatatgtcggtgtttgctggtgatttgaacaatatgagataaagccctcatgacgagggcgtaacattactcagcaataaactgatattccgtcaggctggaatactcttcgccaggacgcaggaagcagtccggttgcggccattcagggtggttcgggctgtccggtagaaactcgctttccagagccagcccttgccagtcggcgtaaggttcggttccccgcgacggtgtgccgccgaggaagttgccggagtagaattgcagagccggagcggtggtgtagaccttcagctgcaatttttcatctgctgaccagacatgcgccgccactttcttgccatcgcctttggcctgtaacaagaatgcgtgatcgtaacctttcactttgcgctgatcgtcgtcggcaagaaactcactggcgatgattttggcgctgcggaaatcaaaagacgttccggcgacagatttcaggccgtcgtgcggaatgccgccttcatcaaccggcagatattcgtccgccagaatctgcaacttgtgattgcgcacgtcagactgctcgccgtcaagattgaaatagacgtgattagtcatattcaccgggcaaggtttatcaactgtggcgcgataagtaatggagatacggttatcgtcggtcagacgatattgcaccgtcgcgccgagattacccgggaagccctgatcaccatcatctgaactcagggcaaacagcacctgacgatcgttctggttcacaatctgccagcgacgtttgtcgaacccttccggcccgccgtgcagctggttaacgccctgacttggcgaaagcgtcacggtttcaccgtcaaaggtataacggctattggcgatacggttggcataacgaccaatagaggcccccagaaacgcggcctgatcctgatagcattccgggctggcacagccgagcagcgcctcgcggacgctgccatcggaaagcggaatacgggcggaaagtaaagtcgcaccccagtccatcagcgtgactaccatccctgcgttgttacgcaaagttaacagtcggtacggctgaccatcgggtgccagtgcgggagtttcgttcagcactgtcctgctccttgtgatggtttacaaacgtaaaaagtctctttaatacctgtttttgcttcatattgttcagcgacagcttgctgtacggcaggcaccagctcttccgggatcagcgcgacgatacagccgccaaatccgccgccggtcatgcgtacgccacctttgtcgccaatcacagctttgacgatttctaccagagtgtcaatttgcggcacggtgatttcgaaatcatcgcgcatagaggcatgagactccgccatcaactcgcccatacgtttcaggtcgccttgctccagcgcgctggcagcttcaacggtgcgggcgttttcagtcagtatatgacgcacgcgttttgccacgatcgggtccagttcatgcgcaacagcgttgaactcttcaatggtgacatcacgcagggctggctgctggaagaaacgcgcaccggtttcgcactgttcacgacgggtgttgtattcgctgccaaccagggtacgtttgaagttactgttgatgatgacgacagccacacctttgggcatggaaactgctttggtccccagtgagcggcaatcgatcagcaaggcatgatctttcttgccgagcgcggaaattagctgatccatgatcccgcagttacagcctacaaactggttttctgcttcctgaccgttaagcgcgatttgtgcgccgtccagcggcagatgataaagctgctgcaatacggttccgaccgcgacttccagtgaagcggaagaacttaacccggcaccctgcggcacattgccgctgatcaccatgtccacgccgccgaagctgttgttacgcagttgcagatgtttcaccacgccacgaacgtagttagcccattgatagttttcatgtgcgacaatgggcgcatcgagggaaaactcgtcgagctgattttcataatcggctgccatcacgcgaactttacggtcatcgcgtggtgcacaactgatcacggtttgataatcaatcgcgcagggcagaacgaaaccgtcgttgtagtcggtgtgttcaccaatcaaattcacgcggccaggcgcctgaatggtgtgagtggcagggtagccaaatgcgttggcaaacagagattgtgttttttctttcagactcatttcttacactccggattcgcgaaaatggatatcgctgactgcgcgcaaacgctctgctgcctgttctgcggtcaggtctcgctgggtctctgccagcatttcataaccaaccataaatttacgtacggtggcggagcgcagcagaggcggataaaagtgcgcgtgcagctgccagtgttgattctcttcgccattaaatggcgcgccgtgccagcccatagagtaggggaaggagcactggaagaggttgtcataacgactggtcagctttttcaacgccagcgccagatcgctgcgctgggcgtcggtcaaatcggtgatccgtaaaacgtgggctttgggcagcagtagcgtttcgaacggccaggcagcccagtaaggcacgacggctaaccagtgttcggtttcgacaacggtacggctaccgtctgccagctcgcgctgaacataatccaccagcattggtgatttctgttcggcaaaatattctttttgcaggcggtcttcgcgctcagcttcgttaggcaggaagctatttgcccaaatctgaccgtgcggatgcgggttagagcagcccatcgccgcgcctttgttttcaaaaacctgcacccatgggtacgttttccccagttctgcggtttgctcctgccaggttttgacgatttccgtcaatgctgcaacgctgagctctggcagcgttttactgtgatccggtgaaaagcagatcacccggctggtgccgcgcgcgctctggcaacgcatcagcggatcgtgactttctggcgcatctggcgtgtcagacatcaaagccgcaaagtcattagtgaaaacgtaagtcccggtgtaatcggggtttttatcgcctgtcacccgcacattacctgcgcagaggaagcaatctggatcgtgcgcaggtaacacctgtttggctggcgtttcctgcgccccctgccaggggcgcttagcgcggtgcggtgaaaccagaatccattgcccggtgagcgggttgtagcggcgatgtggatgatcaacgggattaaattgcgtcatggtcgttccttaatcgggatatccctgtggatggcgtgactgccagtgccaggtgtcctgcgccatttcatcgagtgtgcgcgttacgcgccagttcagttcacggtcggctttgctggcgtccgcccagtaggccggaaggtcgccctcgcgacgcggtgcaaaatgataattaaccggtttgccgcaggctttgctgaaggcattaaccacgtccagcacgctgttgcctacgccagcgccgaggttgtagatgtgtacgcctggcttgttcgccagtttttccatcgccacgacgtgaccgtccgccagatccattacgtggatgtaatcgcgtacgccagtaccatcttcggtcggataatcgttaccaaaaatcgccagcgagtcgcgacggcctacagcaacctgggcgatgtatggcatcaggttattcggaatgccttgcggatcttcgcccatatcgcccgacggatgcgcgccaaccgggttgaagtagcgcagcagggcaatgctccagtccggctgggctttttgcagatcggtgaggatctgttccaccatcagcttgcttttgccgtaagggctttgcggtgtgccggtcgggaagctttcaacgtatggaattttgggctgatcgccataaacggtggcggaggagctaaaaataaagtttttgacgttagcggcgcgcatggcgctaatcaggcgcagagtgccgttgacattgttgtcgtaatattccagcggtttttgtaccgattcgcccacggctttcagcccggcgaagtggatcacggtgtcgatagcgtgatcgtgcaggatctcggtcatcaacgcttcgttacgaatatcgccttcaacaaacgttggatgtttgccgcctaaacgctcgataacaggcagtacgctgcgcttactgttacagaggttatcaagaatgatgacatcatgaccgttttgcagtaattgcacacaggtatgacttccaatgtaaccgctaccaccggtaaccagaactctcataattcgctccattaggcttatggtatgaaataaccatagcataacaaagatgcgaaaagtgtgacatggaataaattagtggaatcgtttacacaagaatttagccgttttttatgcgcgattaagtgattataaaacagagggtttatgaatgattgcgctttttatctgaaaaaagacgcggtttcatgcctgcatgcgtcgaaccgttggccggagagggtgctaaggccgcctccggcaaggtcagcactaccgactcaatatatttttgtcagcacatagcgatagagtccaccgtccggcacgaactcaagacgatgggtaatacaggcaggcgcatcttcagcgtggtgcgaaacaaacaacaattgcgtttcaccttcgctaatcagcacatcaacaaaacggcggataagctggcgattcagcggatcaagcccctgtagtggttcatcgagaataagcaacgtcggatgtttcaccagtgcgcggacaatcagcgccagacgctgctgtccccaggaaagactatggaacggagcgtcagccgtgcgtttatcaatgccgagaatatccagccactgctgcaccagtttttgctggcgatccgaaacggcctgataaatgccaatcgaatcaaaatagccagaaagaatcacattacgcacggtagtgctgacccggtaatccagatgcaaactactgctgacgtaaccgatatgctttttgatatcccagatggtttcgccgctgccgcgacgtcgtccgaaaagcgtcaaatcgttgctgtaaccttgcggatgatcgccagtaaccaggcttaataacgtcgattttcctgcaccatttggcccgacaatttgccagtgttcgcctggattcacctgccagctaaggttattaagaatggggcgatcgttataagaaaccacgccattgttcagcacaatgcgcggttcgttggcgggtaaggcgtgacgtgctgaaggttcatccggctccggcagttgcacaccttcaagctgttcactatgcgccagttgcgcgacgagtgcttgttggagcagttcctctttagcgccagtttccgctaacgtgcaatccgccagcacgccagcaaactggacaaactccgggatctcatcgaagcgattgagcaccagtaccagagtaataccggactgatgtaacgaggcgagtcgctcagccagctgctgacgtgaggcaacatccaggccatcgaacggctcatcaagaatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggtgcatcctttacttcatcctgaatgatctcagccgtagtgcgtccggtgtcatcttcgccagggccgagcatatcggtgttattccgctgccattcgtcgctgacgagtttttgcaattgctcgaaggagagacgagtgatgtgggaaaactggctttgccgttcacctttcaaaagcggaagttcccccgccagcgcgcgggccagggccgatttcccgcttccattcgaaccgacaaacgcccaactatcacccgcgtttaacgttagctgaggcaattgcagcgtttttgtgtcgctaagacgaaacgtgccttgcaaaatttgcaacgatgacattttatatcccactttgtgcagcgattactgacagggatacgtgtttcataacaaattgtcaacacgcttagcacagcgtggcgataatcacgctgtcggcattaaagtaggccgtgacattctgtccttgctgaagagaagtcgcttcatttaccggcactgtggcgcacagtgtttgcccgtcgggtagcgccattaatacttcgcactgctctgcgccgcgctcaatatgactaataatacccggtaattggttgtcagcgttttgcgcgaccgcctcgtcctgagtaatacctacccacggcgcttttagcaatatcaacacttctttgccttcatccagccccagacgcgcgccgctttgtgcggtaattgcgactttcaggcgtgtttttccgtcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctggatttgcgccagtaagtcatagagctgaatcagtcgctgaccatagcgggtcagtactgcgccgccgccacctttaccgcctgttgcgcgctcgaccagaatatgctcacttaactgattcatctcgttaatggcatcccaggcgcttttatagctaataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttctttttctcaacttcctgcttttcctgccgatattttttcttatctacctcacaaaggttagcaataactgctgggaaaattccgagttagtcgttatattgtcgcctacataacgttacattaaggggttaccaatggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaatgatactgaccgatccagaatggcaggcagttttattaagcctgaaagtttcttccctggctgtgctgtttagcctgccgtttgggatcttttttgcctggttactggtgcgttgcacgtttccgggcaaagctctgctcgacagcgtactgcatctaccgctggtgttaccgcccgtggtcgtcggttacttattattagtttcgatgggacggcgcggatttatcggtgaacgtctgtatgactggtttggtattaccttcgcctttagctggcgcggcgcggttctcgctgccgccgtcatgtcgtttccgctgatggtgcgggcaattcgtctggcgctggaaggggttgatgtcaaactggaacaggccgcaagaacactgggggccgggcgctggcgcgttttctttactatcacgttaccgctgaccttaccgggaattattgttggtacggtactggcttttgctcgttctctcggtgagtttggtgcaaccatcacctttgtgtcgaacattcctggtgaaacgcgaaccattccttctgccatgtataccctgatccagacccccggcggggaaagtggagcggcgagactgtgcattatttctattgcgctggcgatgatctccctgttgatttcagaatggctggccagaatcagccgtgaacgggcggggcgctaatcatgctggaactgaatttttcccagacgttgggcaaccattgcctgactattaatgaaacgctgcccgccaatggcatcactgctatctttggcgtctccggtgccggaaaaacttcgctgattaacgccatcagtggactgacgcgcccgcaaaaagggcggattgtcctcaatgggcgggtactaaatgatgccgaaaaaggtatctgcctgacgccggaaaagcgtcgcgttggctatgtttttcaggatgcgcggctgttcccgcattacaaagtgcgtggcaatctgcgctacggcatgtcgaaaagtatggtcgatcagttcgataagctggtggcgcttttaggcattgaaccgttgcttgaccgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacggctgacacgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggtcaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggaactggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaactgggcaatgctgtcggtggtgttatcaccaatcacaatgttggcgcgcgcttttaccgcgtcatcggcgttgcccatcgccacgcctgtaccagcggcttccagcatactgatatcattaaagttatcgccgaatgccacgacgttttccatcgaccaaccttgcgcctcaacccatttcgtcaaacgtttacctttgctgttgccgccgcgtgcaatatcaacctgatcgtgccaggaccattcacactccagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagatgtgcgaatgacatgcccggtcgggtgctcatagaccattgcatcatcgacatacatcagaccgtgaatgtggtgttcattcagcatctcaatgagttgcagggctttaataacgggcattgggtccgcttccagcacggtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgccccggacgatggcgcactgacctttgccgcagagtctgcgctgccgggtagtccgacgcatatttccaccgatcaccaggggcagtttgtctttgtaggttcttacaatgcgggtaacgtgagcgtaacgcgtctggaagatggcctgccagtgggcgtcgtcgatgtggtcgaggggctggacggttgccattccgccaatatctcaccggacaaccgtacgctgtgggttccggcattaaagcaggatcgcatttgcctgtttacggtcagcgatgatggtcatctcgtggcgcaggaccctgcggaagtgaccaccgttgaaggggccggcccgcgtcatatggtattccatccaaacgaacaatatgcgtattgcgtcaatgagttaaacagctcagtggatgtctgggaactgaaagatccgcacggtaatatcgaatgtgtccagacgctggatatgatgccggaaaacttctccgacacccgttgggcggctgatattcatatcaccccggatggtcgccatttatacgcctgcgaccgtaccgccagcctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggtcgggcagggaccaatgtgggtggtggttaacgcacactaaccgctgatttacccggcgcagtctctcctgcgccggtgtattaacctatctcctgtaacgcgtgtctctggcgttcgacgatattggtccacaaattgtctttatcgtcagtccataaattaatcagcaaggcaaaaaagcgttctgctgctggagaaagtacggcatctttacggcgaattattcccaatgttcgacgtataacgggttccaccaatgggataccaataatcgaagaatagggcgcatgaggcattgccaggccaggaagcgccgaaatccccagtcccgcctccaccagtcctaatgacgtcgaaagatgacgcacttcgtaaaaccagtccagcttccagggcttgtcggccagctgttgttctatcaacagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttctttattaattcccgcgcctccgggagcaacctttttcctgcttttgttaacgtaaccttgcgagttgtacgctcaaatagttgaacatgtaaatcttcctccatcttttttattcttcgcgttaatgcaggttgcgtaatattgagtaatttagcggcattgttaaacgaactggactctgccagtatgacaaatgccttcatacttgataattcatgcttcattattactccggaaaatggaagcgacgattttgggtggctggccgttaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccactgaccagtaaagtcgccattattagccgttccagcgatccgcgtgctgatgtcgattatctgtttgcgcaggtaatcgttcatgagcaacgtgtcgataccacgcctaactgcggcaatatgctgtctggtgttggggcattcgccattgaaaatggtttgattgcagcgacttcgccagttactcgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgctggaaccaaaaccggaaaagttttcccgactgataatcagattgattattttgacgatgtcccggtgacctgtatcgatatggcgatgccagtcgtcattattccggctgaatatctgggaaaaacaggttatgaattaccggcggaactggatgccgacaaagcattattagcccgcattgaatctatccgtctacaagcgggtaaagcaatgggcttaggtgatgtcagtaatatggttatccctaaacctgtgcttatttctccagcgcagaaaggcggggcaattaatgtgcgttattttatgccgcattcttgccatcgcgcgctggcgataaccggtgctattgctatttccagtagttgtgcattggaaggcaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaaattcgttgtcaggataaggacaatcaataaaggacttctgtatgagtcatacagaaagaacaggattttaaatgaataagaaatcgttatggaagctaattctgatattagcgatcccatgtattattggttttatgccagctccggcaggattaagcgaactggcgtgggtgctttttggtatttacctggcggccattgtggggctggttatcaagcctttcccggaacctgtcgtactgttaattgccgttgctgcctcaatggtggtggtcggtaacttatccgacggtgcgtttaaaaccaccgccgtattaagcggttactcttcaggtaccacctggctggtgttctcggcgtttaccttaagcgccgcatttgtgaccaccggtttaggtaaacgtattgcctatctgctgattggtaaaatcggtaacaccacgctgggtctgggttacgttacggtattcctcgatctggtactggctccggcaacaccgtctaacaccgcgcgtgcgggcggcattgtgttaccgatcatcaacagcgtggcggtggctttggggtccgaaccggaaaaaagtccgcgtcgtgtcggacattacctgatgatgtccatttacatggtcaccaaaaccaccagctatatgttctttaccgcaatggcggggaacattctggcgctgaaaatgatcaacgacattctgcacctgcaaattagctggggtggatgggcgctggcagccggattgccgggcatcattatgctgctggtcaccccgctggtgatttacaccatgtatccaccagaaattaagaaggtggataacaaaaccatcgctaaagcgggccttgccgaactaggaccgatgaaaatccgcgaaaaaatgctgctcggtgtctttgtgctggcgctgctgggctggattttcagtaagtctctgggggttgatgaatccaccgtggcaatcgttgttatggcaaccatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcattatcgtgcgttatttcttcgcttccggtagtgcctatatcgttgctatgttaccggtatttgccatgctggcgaacgtctccggcgcaccgttaatgttaaccgcgctggcactgttgttctccaactcctatggcggcatggttactcactatggcggcgcggcaggtccggtcatctttggcgtgggttataacgatattaaatcctggtggttggtcggtgcggtactgacgatattaaccttcctggtgcatatcaccctcggcgtgtggtggtggaatatgctgatcggctggaacatgctgtaaatattctcgtcatacttcaagttgcatgtgctgcgtctgcgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagtaataacgaaataattgccgaagaacatttcaccggcgaaattaaaaaagaagaagccaaaaaaggcactattgcctggtctattctctcttcgcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgcgccgtcggcggcactattaacggtgatgaccatgtttttggtttatcggcggcccagcgttatggcggtatttttgtgcctccgcatattgcggtcatccatcaatatatgcgtgagatgatggcaggcggcggcaaaatgatcctcgggtcagacagccacacccgttacggtgcattagggacaatggcagtcggtgagggcggcggtgagttggtaaaacagctgcttaatgacacctgggatatcgactatccgggcgtggttgcggtgcatctgaccggaaaacctgcgccgtatgtggggccacaggatgtggcgctggctatcattggcgcggtgttcaaaaacggttacgtcaaaaacaaagtcatggagttcgttggaccgggcgttagcgcgctctctaccgatttccgtaacagcgttgacgtgatgaccactgaaacgacctgtttaagttctgtctggcaaaccgatgaagaagtccataactggctggcgctgcacggtcgcggccaggattactgccagcttaaccctcaaccgatggcgtactacgatggctgcatcagcgttgatttaagcgccatcaaaccaatgattgcgctgccgttccacccgagcaacgtgtatgaaatcgacacactgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaaggggcaactcagcaaccgctgatttacgggccgaacattaaagactggccggaattgggtgcgctgactgacaatatcgtcctgaaagtgtgctcgaagatcctcgacgaagtgaccaccaccgacgaactgattccttccggtgaaacctcttcttatcgttcaaatccgattggtctggcggagtttaccctgtctcgccgcgatcccggttatgttagcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtctatgcggtgaaaccaggcgatggttctgcgcgtgaacaggcggcgagctgccagcgtgtgattggcggtctggcgaatattgccgaggagtacgcgactaaacgctatcgttctaacgtcatcaactgggggatgttaccgctgcaaatggcggaagtaccaacctttgaagtgggggattacatttacatccctggcattaaagcggcgctggataatccgggtacgacgtttaaaggttatgtgatccatgaagatgcgccggtaacggaaattacgctctatatggaaagtctgactgctgaagagcgcgagattatcaaggcgggtagtttgattaacttcaataaaaaccgtcagatgtaaaaagcgccatgtgaatgtaggtcgcattcggcacttattgtcggatgcgatgcttgcgcatcttatccgacctacgaatcgcatcgaatctgtaggccagataaggcattttcgcagcatccggcacttattgtcggatgcgatgcttgcgcatcttatccgacctacaaatcgcatcgaaccgtaggccggataaggcgtttacgccgcatccggcaaatagttaattgctcttacttcttcgcctctgcaaccactttactacccacgccgcggttattgtattcccacatgcggttgtagttagtgtcattcagattgcgctgtatttcgtcgttatcatctacgctgccggtattacccgcaaacggacgattagagatcaccgcatcggcccacggtttagccgtgttaaaaccttcgttgatggcgctatcacggatcaccacctgaccgttggtattggcatcaacatccagcgagcggcccagttgcgccacaccatcaccgaaagcattgaaacggctgtttacggcgaggaaaccgtagtaaatgttggacagcgtagccggtgcaaacacatacgcttcttgctgagtacgtgagttcaccacgcggaattcggtgttatcgaacaccactgcgccgcgaccagaaacgatatccacatccccttcaatgtagctgttggtcaccagcgtacgcggctgacgattcgtttccagacggttctgcacaccgctgttggtgacaaagaaggtgttctgacgaccgagaatgttaacgttgttaatctgtacctggtcaccatcagtacgcagtgccaccgccggatggttacctgcatctacgctatcgcccagcgtgttttcgatggtcagattttgcagttgcaggccattgttttgtgaccagaagaccgcagagcagagaacaccgatactgtcgctgcgtttgctctggcagctatcgtacatataccacgctggtttacctggcatatatttgccgcgcgggttgacgtcgtgacgccagtcggcagggctcatgccaccatcaagggaaagcccaatcttcacatcaatcggtttttcacctgtaccgtacagagtaattccacccggagcggcagggacatataccgttccctgatactcaccaggcatcacggcaatatactggcgcttgttggtacgcttgataattgccgcatctaccgccgcctgaatcgtggtatgcgttacaccttgagtgcccgccgggccgacaacaaagtcaggttgcgcaggcagggtaatcggggaaggattccacgctgcagcacctggtgtcagggatgcaaaatagtgttgagcatcgaaattctgcgcttcttttgccgacagaatcgggcgagaagaggtaccaggcgcggtttgatcagaaggacgttgatcgggcggggttgagctacaggcggtcagcgtcacgccaaaagccaatgccagcgccagacgggaaactgaaaatgtgttcacaggttgctccgggctatgaaatagaaaaatgaatccgttgaagcctgcttttttatactaacttgagcgaaacgggaaggtaaaaagacaaaaagttgtttttaatacctttaagtgataccagatggcattgcgccatctggcagagtgattaactaaacatcgcagtaatcgaggcgcttgccagagagtggaaatgaacgttaaacccgaccatcgcgccgctggcaccttcatcgacatcaatacgttctatatccagcgcgtgaacggtaaaaatgtagcgatgagtttcgcctttcggcggtgctgcgccatcgtacccggttttaccaaagtcggtacgcgtctgcaaaacgccgtctggcattgctaccagaccagagccaaacccttgcggtaatacgcgggtatcagcgggtaagttaacaactacccagtgccaccagccggagccggttggcgcatccgggtcgtagcaggtgacaacaaaacttttcgttcccgcaggaacatcatcccacgccagatgcggtgaaatattatcgccatcgtaacccatgccgttaaagacatgacgatgcggcaatttatcgccatcgcgcagatcgttactgatgagtttcatgaaccctcctttcttgtttgcagaaagtgtagccagaaaccctcacgcggacttctcgttattggcaaaaaaatgtttcatcctgtaccgcgcggttaaccgctgcggtcagacgctgcaactgttgcgggagaataatatagggcggcatcaggtaaatcagtttgccaaaaggccggatccagacaccctgttcgacaaagaatttttgcagcgccgccatattcaccggatgagtggtttcgaccacgccaatggcccccagtacgcgcacatcggcaaccatttcggcatcacgggcgggggcaagttgctcgcgcagctgtacttcaatatccgccacctgttgctgccagtcgccagattcgagaatcgccaggctggcgtttgctgccgcgcaggccagcggattgcccataaaagttggcccatgcataaagcaaccggcttcaccgttactgatggtttctgcaacctcgcgcgtggtgagtgtggcggaaagggtcattgtgccgccggttaaggctttaccgaggcacaaaatgtccggcgcgatttctgcatgttcacaggcaaacagtttcccggtacgaccaaatccagtggcgatctcgtcggcaatcagcaagataccttcgcgatcgcatattttgcggattcgttttaaccattccggatggtacatgcgcatcccgcctgcgccctggacaatcggctcaatgatcaccgccgcgatttcatgacgatgcgccgccatcaggcgggcaaagcccaccatatcgcgctcatcccattcgccatccatgcggctttgcggggcgggagcaaacaggttttctggcaggtagcctttccacagactgtgcattgagttatccggatcgcacaccgacatcgcgccaaaggtatcgccatgataaccattgcggaaggtcagaaaacgctggcgcgcttcgcctttggcttgccagtactgcaacgccattttcatcgccacttccaccgctacggaaccggagtccgcgagaaaaacgcactccagcggttgcggcgtcatcgccaccagtttgcggcacagctcaatggctggcgcatgggtgataccgccaaacatcacatgcgacatggcatcaatttgcgacttcatcgccgcattaagctgcgggtgattgtagccgtggatcgccgcccaccaggacgacataccgtcaaccaggcgtctgccgtcagacaaaatcagctcgcaaccttcggcgctcaccaccggataaaccggcagaggggaggtcatggatgtgtatgggtgccagatatggcgttggtcaaaggcaagatcgtccgttgtcataatcgacttgtaaaccaaattgaaaagatttaggtttacaagtctacaccgaattaacaacaaaaaacacgttttggagaagccccatggctcaccgcccacgctggacattgtcgcaagtcacagaattatttgaaaaaccgttgctggatctgctgtttgaagcgcagcaggtgcatcgccagcatttcgatcctcgtcaggtgcaggtcagcacgttgctgtcgattaagaccggagcttgtccggaagattgcaaatactgcccgcaaagctcgcgctacaaaaccgggctggaagccgagcggttgatggaagttgaacaggtgctggagtcggcgcgcaaagcgaaagcggcaggatcgacgcgcttctgtatgggcgcggcgtggaagaatccccacgaacgcgatatgccgtacctggaacaaatggtgcagggggtaaaagcgatggggctggaggcgtgtatgacgctgggcacgttgagtgaatctcaggcgcagcgcctcgcgaacgccgggctggattactacaaccacaacctggacacctcgccggagttttacggcaatatcatcaccacacgcacttatcaggaacgcctcgatacgctggaaaaagtgcgcgatgccgggatcaaagtctgttctggcggcattgtgggcttaggcgaaacggtaaaagatcgcgccggattattgctgcaactggcaaacctgccgacgccgccggaaagcgtgccaatcaacatgctggtgaaggtgaaaggcacgccgcttgccgataacgatgatgtcgatgcctttgattttattcgcaccattgcggtcgcgcggatcatgatgccaacctcttacgtgcgcctttctgccggacgcgagcagatgaacgaacagactcaggcgatgtgctttatggcaggcgcaaactcgattttctacggttgcaaactgctgaccacgccgaatccggaagaagataaagacctgcaactgttccgcaaactggggctaaatccgcagcaaactgccgtgctggcaggggataacgaacaacagcaacgtcttgaacaggcgctgatgaccccggacaccgacgaatattacaacgcggcagcattatgagctggcaggagaaaatcaacgcggcgctcgatgcgcggcgtgctgccgatgccctgcgtcgccgttatccggtggcgcaaggagccggacgctggctggtggcggatgatcgccagtatctgaacttttccagtaacgattatttaggtttaagccatcatccgcaaattatccgtgcctggcagcagggggcggagcaatttggcatcggtagcggcggctccggtcacgtcagcggttatagcgtggtgcatcaggcactggaagaagagctggccgagtggcttggctattcgcgggcactgctgtttatctctggtttcgccgctaatcaggcagttattgccgcgatgatggcgaaagaggaccgtattgctgccgaccggcttagccatgcctcattgctggaagctgccagtttaagcccgtcgcagcttcgccgttttgctcataacgatgtcactcatttggcgcgattgcttgcttccccctgtccggggcagcaaatggtggtgacagaaggcgtgttcagcatggacggcgatagtgcgccactggcggaaatccagcaggtaacgcaacagcacaatggctggttgatggtcgatgatgcccacggcacgggcgttatcggggagcaggggcgcggcagctgctggctgcaaaaggtaaaaccagaattgctggtagtgacttttggcaaaggatttggcgtcagcggggcagcggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagaaaaactgcgtcagcaaggctgctgggtcacggcgattcgcccgccaaccgtacccgctggtactgcgcgactgcgcttaacgctaaccgctgcgcatgaaatgcaggatatcgaccgtctgctggaggtgctgcatggcaacggttaataaacaagccattgcagcggcatttggtcgggcagccgcacactatgagcaacatgcagatctacagcgccagagtgctgacgccttactggcaatgcttccacagcgtaaatacacccacgtactggacgcgggttgtggacctggctggatgagccgccactggcgggaacgtcacgcgcaggtgacggccttagatctctcgccgccaatgcttgttcaggcacgccagaaggatgccgcagaccattatctggcgggagatatcgaatccctgccgttagcgactgcgacgttcgatcttgcatggagcaatctcgcagtgcagtggtgcggtaatttatccacggcactccgcgagctgtatcgggtggtgcgccccaaaggcgtggtcgcgtttaccacgctggtgcagggatcgttacccgaactgcatcaggcgtggcaggcggtggacgagcgtccgcatgctaatcgctttttaccgccagatgaaatcgaacagtcgctgaacggcgtgcattatcaacatcatattcagcccatcacgctgtggtttgatgatgcgctcagtgccatgcgttcgctgaaaggcatcggtgccacgcatcttcatgaagggcgcgacccgcgaatattaacgcgttcgcagttgcagcgattgcaactggcctggccgcaacagcaggggcgatatcctctgacgtatcatctttttttgggagtgattgctcgtgagtaaacgttattttgtcaccggaacggataccgaagtggggaaaactgtcgccagttgtgcacttttacaagccgcaaaggcagcaggctaccggacggcaggttataaaccggtcgcctctggcagcgaaaagaccccggaaggtttacgcaatagcgacgcgctggcgttacagcgcaacagcagcctgcagctggattacgcaacagtaaatccttacaccttcgcagaacccacttcgccgcacatcatcagcgcgcaagagggcagaccgatagaatcattggtaatgagcgccggattacgcgcgcttgaacaacaggctgactgggtgttagtggaaggtgctggcggctggtttacgccgctttctgacactttcacttttgcagattgggtaacacaggaacaactgccggtgatactggtagttggtgtgaaactcggctgtattaatcacgcgatgttgactgcacaggtaatacaacacgccggactgactctggcgggttgggtggcgaacgatgttacgcctccgggaaaacgtcacgctgaatatatgaccacgctcacccgcatgattcccgcgccgctgctgggagagatcccctggcttgcagaaaatccagaaaatgcggcaaccggaaagtacataaaccttgccttgttgtagccattctgtatttggttaaattgcgagcgagatcgcgtcttcgattgactgcaatttaaccaattaaattctaaaataatcacgaaaaaaattttacttccgcctcatgcggcgaatgtgggaattgcccaggcggcgggggataggggctggagacagttatccactattcctgtggataaccatgtgtattagagttagaaaacacgaggcaagcgagagaatacgcggcttgcacgcgaattggcgttaaagacggctcaaagaaatatcttttattttttaactggttagataaatgcaatggcagtcactgaacaggcatctcttgccataaaactgtcatcactcatcttgacaaatgttaaaaaagccgttgctttggggataacccggtaaggccggagttttatctcgccacagagtaaattttgctcatgattgacagcggagtttacgctgtatcagaaatattatggtgatgaactgtttttttatccagtataatttgttggcataattaagtacgacgagtaaaattacatacctgcccgcccaactccttcaggtagcgactcatgagtaaaccgttcaaactgaattccgcttttaaaccttctggcgatcagccagaggcgattcgacgtctcgaagaggggctggaagatggcctggcgcaccagacgttacttggcgtgactggctcagggaaaaccttcaccattgccaatgtcattgctgaccttcagcgcccaaccatggtacttgcgcccaacaaaacgctggcggcccagctgtatggcgaaatgaaagagttcttcccggaaaacgcggtggaatatttcgtttcctactacgactactatcagccggaagcctatgtaccgagttccgacactttcattgagaaagatgcctcggttaacgaacatattgagcagatgcgtttgtccgccaccaaagcgatgctggagcggcgtgatgtggttgtggtggcgtctgtttccgcgatttatggtctgggcgatcctgatttatatctcaagatgatgctccatctcacggtcggtatgattatcgatcagcgcgcgattctgcgccgactggcggagctgcaatacgctcgtaatgatcaagcattccagcgtggtactttccgcgttcgtggcgaggtgatagatatcttcccggcagaatcggatgacattgcacttcgcgtggaactgtttgacgaggaagtggaacgattgtcgttatttgacccgctgaccgggcagattgtttccactattccacgttttaccatctacccgaaaacgcactacgtcacaccgcgcgagcgcatcgtacaggcgatggaggagatcaaagaagagctggccgccagacgcaaagtgctgttggaaaacaacaaactgctggaagagcagcggctgacccagcgtacccagtttgatctggagatgatgaacgagctgggctactgttcggggattgaaaactactcgcgcttcctctccggtcgtggaccgggtgagccaccgccgacgctgtttgattacctgcctgccgatgggctgctggtcgtcgatgaatctcacgtcaccattccacaaattggcggcatgtatcgcggtgaccgggcgcgtaaagagacactggtggagtacggcttccgcctgccatcagcgctggataaccgtccgcttaagtttgaagagttcgaagcattagcgccgcaaaccatctatgtttcggcgacgccgggtaattacgagctggaaaaatccggcggcgatgtggtggatcaggtggtgcgtccaaccggattgcttgacccgattatcgaagtgcggccggtggcgacacaggttgatgatcttctttcggagattcgtcagcgagcggcaattaacgaacgcgtactggtcaccacactgaccaagcggatggcggaagatcttaccgaatatctcgaagaacatggcgagcgcgtgcgttatcttcactcagatatcgacaccgtcgaacgtatggagattatccgcgacttgcgtctgggtgagttcgacgtgctggtagggatcaacttactgcgcgaaggtctggatatgccggaagtgtcgctggtggcgatcctcgacgctgacaaagaaggcttcctgcgttccgaacgttcgttgatccagaccattggtcgtgcggcacgtaacgttaacggtaaagcgattctctacggcgataagatcaccccatcaatggcgaaagcgattggcgaaaccgaacgtcgccgtgagaaacagcagaagtacaacgaggaacacggaattacgccgcaaggcttgaacaagaaagtggtcgatatcctggcgctggggcagaacattgccaaaaccaaagcgaagggcagaggaaaatcgcgcccgattgttgagccggataatgtgccgatggatatgtcgcctaaagcgttgcagcagaaaatccatgagctggaagggttgatgatgcaacacgcgcagaatctggagttcgaagaagcggcgcaaattcgtgaccagttgcatcagctgcgtgagctgtttatcgcggcatcgtaacaggatagcgaagaagactgatgacaaacggaaaacagcctgatgcgctacgcttatcaggcctacattttctccgcaatatattgaatttgcgcggtttgtaggccggataaggcgttcacgccgcatccggcataaacaacgcgcactttgtcttcaataggaagccggaattttccttcggatttccgttaacctaaagcctgtaacgccttttccagcgcgttatgtaacaactggcggtcatgacgatacggaatatcgctggcctccagtacctcctggatcacaatccgctctttcaccgccgagacatccacttttggcccgacgatgaccgcatcaatgacctttttaccaacatactgctccataattgccagcttgctttccagcttcaaattagccgcaggtaaactcaactcacgccccagattgccgatataaaccatcggcgctggcgtgcggcgtaatgcctgggcgatttccttcagcagcagaattggcatcaggctggtataaaaactgccaggcccaataatgatgagatccgcttcattgatagcgtgaaccgcctcacgcgttgcgggtacattaggcgttaacaataactcttgaatcggcgtagttaactggtcgatattgacctcgccgtaaacttcatgcccctgatcgtcaatcgccatcagatcaacaggatgctctgacattggaatcaaatgcgtatccactttcagcagattacgaattaaattgatggcttccagaggccgcacgctaaggtgatccagcgcctttaacatcaagtttccgagattatgaccggaaagttcgccattgccaccaaaacggtattcaaacatcgcggaggcgacgctcggttccgttatcagctggttgaggcagttgcgcatatcgccccaggcaatgccgccttctgaacggcgaatacgccccgtcgagccaccattatcggtggtggtgacgatacccgttaaacgagaacccaaagacgaaagtgatgagagaacgcgtcccagtccatgccctccgccgagagcaacgacacgatcaagatcagccagcgtacgattgcgcatatagtttcctggagtcagattatccgcgctacagtagcgcaaattgcggggaaacagcaattaacctgccaatattgaggatacaaactattttcttctacctctaaaggacgatgcacgctatgcctccctgatgatgtatatcaaagtaaaaccgccattttcccttattctgtagcgaaatagcacgatcatgacgctatatacatgattacatagcgaaagtgtggatggtaaaaatctcatttacacgctagtatcggcataaccactaaacactctagcctctgcacctgggtcaactgatacggtgctttggccgtgacaatgctcgtaaagattgccaccagggcgaaggaagaaatgacttcgcctcccgtatctggaaaggtgtacatggcttcacaactgactgatgcatttgcgcgtaagttttactacttgcgcctgtcgattaccgatgtgtgtaactttcgttgcacctactgcctgccggatggctacaaaccgagcggcgtcaccaataaaggctttcttaccgtcgatgaaattcgccgggttacgcgcgccttcgccagactgggcaccgaaaaagtgcgcctgacaggaggagagccgtctttacgccgcgactttaccgatatcatcgccgctgtgcgggaaaacgacgctatccgccagattgcggtcacaaccaatggttaccgtctggaacgcgatgtggcgagctggcgcgatgcgggacttactggcattaacgtcagtgtcgacagtctggacgcccgccagtttcacgctattaccgggcaggataaattcaaccaggtcatggcagggattgatgctgcatttgaggccggttttgagaaggtcaaagtcaataccgtgctgatgcgtgatgttaatcatcaccagctcgacacctttctgaactggatccagcatcgccctatccagctgcgtttcatcgaactgatggaaacgggcgagggcagcgagctcttccgtaagcatcacatctctggtcaggttctgcgtgacgagctactgcgtcgcggctggatccaccaattacgtcaacgcagcgacggtcccgcgcaagtcttttgccatccagattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatacccagcaacaggcgctggaagcgcgtatttcagcggcgctgcgggagaagaaacagacccatttcctgcatcaaaacaacaccggtattacgcaaaacttatcgtacattggcggctaaaacgtcaaaaggagagatcagatgagtcaggtaagcactgaatttatcccgacccgtattgctattcttacggtttctaatcgtcgcggtgaagaagacgatacctccggtcactatctgcgcgattcggcgcaagaagcgggccatcacgttgtcgataaagccattgtgaaagaaaaccgctacgctattcgcgctcaggtatctgcgtggatcgccagcgacgatgtacaagtggtattgattacgggtggtactggcctgacggaaggtgatcaggctcccgaagcattgctgccgttgttcgaccgtgaagttgaaggttttggtgaagtgttccggatgttgtcgtttgaagagattggcacttccacgttgcaatctcgtgcggtagcgggcgtcgccaacaaaacgctgattttcgccatgccgggttcgaccaaagcgtgccgtaccgcatgggaaaatatcatcgcgccgcagctggatgcccgtacgcgtccgtgtaatttccatccacatttgaagaaataagtatgtcgcaactgacccatatcaacgccgctggcgaagcgcacatggtggatgtctccgccaaagcggaaaccgtgcgtgaagcgcgggcggaagcctttgtcaccatgcgcagcgagacgctggcgatgattattgatggtcgccaccacaaaggcgacgtatttgccactgcgcgtattgccggtattcaggcggcaaaacgcacctgggatctgatcccgctctgtcatccgctgatgctcagcaaagttgaagtcaatttacaggccgagccggagcacaatcgggtgcgtatagaaaccttatgccgcctgaccgggaaaaccggtgtcgaaatggaagcattaaccgcggcctccgtggcggcgctgaccatttatgacatgtgcaaagcggtgcaaaaagatatggtgattggtccggtacgtttgctggcgaagagcggcggcaagtcgggtgactttaaggtggaagcggatgattaaagttctttttttcgcccaggtgcgcgagttggtgggaacagatgcaaccgaagtggctgcggatttcccaactgttgaagcgttacgccagcacatggctgcgcagagcgatcgctgggcgctggcgctggaagatggcaaattactggctgccgtcaaccagacgctggtgagttttgaccatccgctgactgacggcgacgaagtagctttcttcccgccggtaaccggaggttaagatggcagaaaccaaaattgttgttggtccgcagccgttcagcgtaggagaagagtacccgtggctggcggagcgtgacgaagacggtgcggtagtcacctttactggtaaggtgcgcaaccataacctgggcgacagcgtcaacgcattaaccctcgaacactatccggggatgactgaaaaagcactggcagaaattgttgatgaagcgcgtaaccgctggccgctggggcgcgtcactgtgattcaccgcatcggggaattatggccgggcgatgaaatcgtttttgtcggtgtcaccagtgcgcatcgcagcagtgcgtttgaagccgggcagtttattatggattatctcaaaacccgcgcaccgttctggaagcgcgaagccacgccggaaggcgaccgctgggttgaagctcgggagagcgatcagcaggcggcaaaacgctggtagttttttgttagccggataaggcaccgctgcgtccggcaatttcaccgctcagtacatacgtttacgctgcgtcgatgcacagcctcatcattttgcagtatccttaagatattccttatatcttcaggagatcgtcatggacagattcccacgttctgattcaatcgtacaaccccgggctggcttgcaaacttatatggctcaagtctatggctggatgaccgttggcttgttgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtatattcattgtctataccgctgcttctatcgccagtactttcgtcgttactgccgggatgttcggcgcaatgagcctgtacggttacaccacgaagcgcgatttaagtggctttggcaatatgctgtttatggcgttaatcggcattgtgctggcatcgctggtcaacttctggttgaaaagcgaagcattgatgtgggcagttacctacatcggcgtgattgtctttgtcggattgacggcgtatgacacgcagaaactgaaaaatatgggtgagcagattgatacccgcgacacgtcgaacctgcgcaaatattccattcttggcgcgttaaccttgtatctggacttcatcaacctgttcctgatgttgttgcggatcttcggcaaccgccgttaattctttttcaccatcactatcccggccatgtgtcgggatttttttcttactaaaaacgacacttaacaagtaccaggtataaaatatgccttatggacgagcggaagcgttttctgtatccataaatgcaaaagtattttgtatgcgtggttttaaatttattgatggtgaatattaatattttttctaaggataactaaaagaatggaatcatactcgcaaaacagcaataaattagattttcagcacgaggccaggatattaaacggtatatggctcattaccgctttaggtttggtggcaaccgcaggactagcctggggagctaagtatatcgaaattacggcaaccaaatatgattcaccaccaatgtatgtcgccatagggttattattactttgtatgtatggcttaagtaaggatatcaacaagataaatgccgccatcgcgggcgtaatatatctgtttttactctctttggtggcgattgtcgttgcaagtttagttcctgtatatgccattatcatcgtgttcagcactgcgggcgcgatgtttttaatcagtatgctggccggtttattatttaatgttgatcctggttctcaccgttttatcattatgatgacgttgacagggttggccctggtaatcatcgtgaatgcggcattaatgagtgaacggcccatttggataataagttgcttaatgattgtgttatggtcaggcattatctcgcatggacgaaataagctccttgaattggcggggaaatgccatagtgaagagttgtggagtccggttcgttgcgcttttacaggtgcattaacactctattactattttatcggcttctttgggatacttgccgcgatagctataacgcttgtctggcaaaggcatacgcgtttttttcattagccgtaaatgcacatactaaagaacttaactaaacttcacatcgccgcttcatttttcgcccgtagcttcttcgcctggctttccagcaacaggtaacagatcagcgccagcagcagtgggataaagtaatacagcacacggtaagcgagtagggcggcgataattgtacctttggaggtatgctccccagccagtagtgcgataaacaccgcttccagcacaccgatccccgccggaatatgcacgatgacgccagcaatactactaaccagtaacacgcccagtacaaagaaatagttcacgctttgaccaagtaacagccagataatcgcccccattaccatccagttaacgctggaaatcagcatctgagcgagggcgaatttccatgaaggcagcaccagcttttgccctttgatggtcatatggcggtgcttcgcgaaagcgcaaaaccacaaataaaccgcgataatcatcagtaagccaatgccgagaatacgcagcgtagtttgatcgacataccagtgatccggcaactccaccacgcctgcggtaaagataatccctgccagtaaaatgtagcccagccagttggtggtaatactgagcgagaaaatccgcgtaatagtgctaccgggcaaccccagacgagagtacaaacgatagcgcataccaatgccgccgacccaggtactgagcgtcaggttgaaggcgtagcagataaacgacaccagcatcacctggcgcttcgccagtttgtgaccgcagtaaaagcgggcgagcaggtcatagcagccgtaaatcagatagctgacgaccaccagcccgaccgcactaagcagcgcaacgcgattgtagtcgcggatgaccttccagacctcttcccagtccacttttttggcgtagaccaccagcaacacaatcaccgcgataaaaaacagccaggtgaggatcttctttgctaagcgccagcgcgggtgtgatttactcatcagggttttacccccgtgttttcagtttctacccgatcctgcgtttccattgtcggttgtgcgggcggatcaacctgcgccagacgtggcgtgtgtgccggaagccagccaaccagcgccgggaagtggcgtaaaaagtggaacgccagcacgcttttggtcaggttccaccaggtgcgtttgggcagcatggtttcatccacctgctgacaatctgcggcaataatgccgttcagattatcgcgcagcgtctggttaaaatgacgatcgtggatgatgacatttgcttcgagattcagtgacaaactgagcggatcgagattactggaccctactgtcgcccagtgatcgtccatcaatgccactttgccgtggagcgggcggcggcggtactcaaaaacctgaacgccgcctttaaccagatagttatacagcaagcgcgcaccgactctgacaatcggcatatccggttcgccctgaatgatcagtttgatccgcaccccgcgccgtgccgctttacgcaaggcgtgtaaaaatcgatagccggggaagaagtaggcgttggcgataatcacttcccgccgcgcctgagtgagcattttcaaataatggcgttcaatatcatcgcgatgttcttcgttatcgcgccagaccagcaatacctgcgcttctcccggctggcggttctcttccgctttgtgatgacgtcgccaccagcgtcgtgccgcgctctgtccaggcaggttttccagctcaaactggagaatatcttcgacaatcggcccttcaaggcgtaccgcgtaatcctgtttagcctctggaccgtagctggacatatgctcggcggagtaattcagcccgccaataaaggctatacgcgcgtcgatcaccacaattttgcgatgcatccggcgaaacacattggtgcgcataccaaaaaggcgagggcggggatcgtagtagcggaacactacgccagctgccgtcagttcattgacaaactcatcgctgagatccggcgaaccgtagccatccagcaagacttccgctttaaccccgcgttgcgctgctgccagtagtgccgcatgcagttgtttgccgacgtcatcctcaaaccagataaacgtttcaagaatgatgcgttcttgtgcctcgccaatcgccttaaacaccgcgggataatattgctcgccgttttccagcaactggatcttattgccttcgcgccagctacatttcataaatgaatctccgcacttaaaggggcatgatcagaaaggtgtcgccatgtccgcagcggcaacgcggttggcgcgctggcgctggcatttttgacgtagatcctgtccagtcgtagtagaggaaattgcaccggaaacgtgcgcgccgggcgtccgtgggcgcgggtaaaaatctcatccagtccggcctgcacttttaacggatgattagctttttgccgccagtcattgaaatcacccgccaccaataccggttcgccgtccggtagctcattcacccattcggcgagcatcgcaagctgcgcctgacggtgcgcctcacgcaggcccagatgtacgcacatcacatgaatcgcttttccggtcatcggcggcacaatgcggcagtagagcacgccgcgcttttccgcaccatcgaccgaaacatcgcgattctcataatgttcaatgggataacgcgacagtacggcgttgccgtgatgcccttccgggtatacggcattgcgaccgtaggcaaaatcgctccacatagtgtcggcgagaaactcgtagtgcgaggtatcgggccagttttccacatgcagcggatgaacttcgtgcgcgcccatcacttcctgcaggcaaacaatatcggcgctgacggtacgcacggcgtcgcgaagttccggcaaaatgaagcgtcggttaaacgcggtaaagcctttgtgaatattgatggtgagcaccttgaacgaaaattgttgtgtttgatcgggcataattttcctgtctttgcctcttatctcattgaaatagtgtagtcggcgtcacaaaaaggtgcggtcttacggaattttccgtaaagttcggtactctgagtaagtagagataaattcttcaggagagaagccatgaagtggcaacaacgtgttcgtgtcgcaacgggtctaagttgctggcagattatgttgcatttactggtagtggcgctgctggtggtgggctggatgagtaagactctggttcacgtcggcgtgggattatgcgcactgtattgtgtcacggtagtgatgatgctggtgtttcagcgccaccccgagcaacgctggcgtgaggtggcagacgtgctggaagagctgaccacgacctggtattttggcgcagcgctgattgtgctgtggctgttgtcccgcgttctggaaaacaactttttgctggcaattgcagggctggcaatccttgccggcccggcggtagtgtctttgctggcgaaagataagaagttacatcaccttacgtctaaacatcgcgtacgccgctgaccctgtcgtggccgttatcaccagtagcggccacaaactattccacacaatatccagactcgcatccttcaaataaatctgcttggtaatgtccgtaaagtggcgaatagggttaatccacgtcaggttttgcagccataccggcatgttttccaccggagaaacgtaaccggaaaggagaatggcgggcatcataaagacaaacacgccgataaacgcctgctgttgtgttgaacagagtgatgaaatcaacagaccgaatcccaccagcgataaaccataaatcaccatcgtaaagtagaacagcgccagcgatccggcgaaggggatttgatacgcccagataccaatcgccagcacaatggtggcctggaaggtggcgacaattaacgccggtacggctttgccgatgaagatctgccaggtggtgagcggcgaaaccagtagctgatcgagcgtaccttgttcacgttcgcgggcgacggaaagtgaagtgacgatcattacgccgatagtggtgatcatggcgatcagtgacggcaccacaaaccatttgtagtcgagattcgggttataccagttgcgtaccaccagctcgctgttgttaggtttcggttttccttccagcagctcctgctgataatttttgacgatctgttgcaggtagttggcggcaatttgcgcactgttggagttacgcccgtcgaggatcaactgcaaaggcgcggtctggaaggtatccagtttgcgcgagaagtcagccgggaaacgcaccagtagtaacgccttttgtgtgtcgatggttgggcggatctcctgtgggcttttcagcagcagcacatgagtaaaggcgctggcgcgggcaaaacgttgggtcagctccaccgaatgctcgccgttatcttcatcgtagatggcgatggtggcgttagtcacttccagcgtggcggcgaacgggaacaggatcacctgaattagcacgggtaaaatcagaatcgcgcgggtttgcggttcgcgcagcaacgactgcaactctttgcggattaacgtccataagcgatgaaacatgctcttctccctaatccagccgacgtttggttttcagccacgtcaggccgataaacatcaccgccgaagcgatcaaaaacagcacgtttaccaccagcaccactggaatattcccggcgaggaacaggctttgcagggtgctgacgaaataacgagcgggaataatgtacgtcaccgcgcggatcaccgcgggcatactgtcgatctgaaaaataaagccggaaagcataatcgacggcagaaaagcggcgttcagggcgacctgagcggcattgaactggttgcgggtaatcgtggaaatcagcagccccatccccagggtactgagtaaaaacaggctggagataaaaaacagaatcagcagcgacccgcgatacggcacgccgagaataaacactgacaccagcatacacagcaacatcgccagcatcccgagaaagtaataagggatcagcttacacagcagcagttccgtgcgggtaatctccgtagagagcagagcctccatggtgccgcgttcccattctcgcgccaccaccagcgaggtgagaatcgcgccgatgaccgtcatgataatggtcaccgcaccggggataatgaagtgctggctaatcgccgccgggttaaaccagtagcgggtttgtacatcaataagcggttcaaaagtctgcccgttgtcctccgctcgctgcatttgccagatctgccagatcccttcgacatacccctgtacaaagttagcggtattcggctcactgccgtcggtgatcacctgaatcggtgcggtggcgttggcgcgctccatctgttccgcaaaatccaccggaataaccaccagaccgcgaattttccccgcctgcattttggcgatcagttcctgacggttatcgctgatggtggcgtcgatgtagggcgaaccggtcatggtgtgggtgaaatccagcgccgcttcgctacgctgttccagtaaaatcccgacccgcagcttgctggagtcgaggttaatgccgtaaccaaaaataaacagcagtagcagcgggatcactaccgcaatcagccagctactcggatcgcgaacgatctgccgcgtctctttaacgcacagcgcccgtacgcgacgccaggacaggatcgggttactcattgctatgctccttatcccagtcgtggatcaactgaataaaggcttgctccatggtgggatcgggttgctcatcgttagccgactgtgctttcaaatcgtccggcgtgccgctggcgattaatttcccgcggtacaccaggccgatgcggtcgcaatattccgcttcatccataaagtgggtggtgaccatcaccgtgacgcctttctctaccatgctgttgatgtgcagccaaaattcacggcgggtgagggggtcaacgccggaagtcggttcgtcgagaaacagaatgtccggttcatgcatcagcgaacaggccagcgccagccgctgtttaaaacctaatggcagttcatcggtggcgtgggaggcgatacttttcaggccgaacgcctcgctcatgcgggagattttttcgttctgcgcccgaccgcgtaagccatacacaccagagaaaaagcgtaaattctgttcgaccgtcaggttaccgtagagcgaaaatttttgcgccatatagccgagatgctggcgcgctttaccggaactctctttcagatccatccccagcaccagcgcctggccggaagtcggcaccagcaaaccgcacatcatcttaaaggtggtcgatttacccgcgccgtttggccccagcaaaccaaaaatctccccacgtttaacggcaaagttgacgtgatcggtggcggcaaaatccccaaatttcttggtcagttctttcgcttcgatcaccgtctcgccgggtgtgccttctaccgtatgtaatattgcgcccagcggcgattccgaggttccggcaccgcccagcaaatcaataaacgcatcttcaaaacgcggcgtagtttcgttgatgttgatttccggcatcccgtcggcatggcgaatatcgtctggtgtggcctcttttttgaggatcagacgtaccgatttcccctgaatcatgccgtcgctgacctgcggcagtttcaaggcgcgttgcaacagtttgcggttgccctcgtgtggactggtcatcagaaagctgcgtccggccatggtttgtgtcagggcttttggttctccctgatacagcaactcgccttcgttcatcagtaacacgtcacggcactgctcggcttcgtcgagatacgaggtactccagaggattaacatcccttcgcccgccagctcatgcaccatctgccacagttcgcgccgtgagatagggtcaacgccgacgccgggttcatcgagcagcaacactttcggttcgcccaccagggtacaggccagaccgagtttttgtttcatcccaccggagagcttgcccgccaggcgtccggtaaacggcccaagagacgtaaactccagcaggcgagcaaaagtttgcttacgtgcctcgccggtgacgctgcgcaaatccgcgtacagattgaggttctccatcaccgtgagatcttcatacagaccaaatttctgcggcatataaccgagcacggcgtgcagcgcgccgtcgtttttgatcggatcaaagccaatcaccgtggcactgccgctgtcgggtttcagtaatcccgccaacatccgcatcagcgtggttttacctgcaccgtccggccccaccaaccccgtcacataaccggcgtgaatggtacaatcgagcggcgcgacggcgggcttgtccatgcccggaaagcgtttttccaggccgttcagcgtgataacggcatcattcatgtcctgcctcgtcaccgaattgtaccgtcactggcattccctggcgtaacgcatcatcggcgtcggtcaccacaatacgcaggcgatagacgaggtcggtacgcagatccggcgtttcgacggttttcggggtaaattcagcagtcggcgaaacgaaaccaatctgcccgtgatacggcttgtccgggcgaccatcggtataaagcagcactttgcgccccggctgggcctggtcaagattacgttcatcaacataagcgcgcacccacaccggacgcgttagtgaaacggtaaacaccgtgccaccttcattgaggaccgtgcctggctccaccgcgcgcgttaacagcgtgccatcagacggggctatcaacgttgagtcctgtaaattcaactccgcctgcgccagttgcgcctgcgcctgttcgaggctggctttcgcctgagcgatgtcctgttcacggttaccggaacggtactgacgcaatttatcctgtgctgatttcagcgttgcctgcgcctggtcgcgcgaggagcgggcattttccaggtcatttgccgaaatagtgcggcttttccacaacccttgctggcggttatagaagttctgcgcatagtcataggcggcttgcgcctgtttcaccgctgcggcggcctgagcgatttcttcattgcgatacccggcaagcatcaggtcatactgcgcctgtgccaccgaaacacccgctttcgcctgcatcagggcaatctcatacggcttgtgatccagttcgcccagcacctggcccgctttgatagcatcaccttcgtccaccgccagcgattcaacgcgccccccaacacggaaactaagatttaccgtacgaatatccacgttgccatacagcgtcaggccgttatcctggcggctttgataccaccagtagcctccggcaaccacggcggcaagtaccactaccgccaatccgatcacgacaggttttttcatcactacaaactcctttgcgataatccttgcaaaatcaggtcgatatgacaggtcaccgtctggttgatcagttcggtcttttcttcatcgaacgcggtccagccggtacgtaacagaattgtttctttgccaagacggaacgccagaatctcaccaatcaacgcatgggtatgaaggatcatgcgggtgtcattggcgtcgcagccggtccaggcggcaatcaggcgtgtcaggtggctgtgtagcggactaatcacctgttcgtgcaccaggtggtaggctgccgtgggagagagctgctcacgggagataaacttgctgaggttgacggtgtcatcctgggtgagcagcttaatcatgttcctgcaggcgcgaaggatcagttcacggatggcagcccgatcaggctgtggttgcgcgaacaagcgttcggcttcctcggcatgcggacggaactgctcgccaataaaatcggcaatccactgggcgcaggcgaggtacaaatcttctttcgaaccgaagtagtaggtgatggcagcgatattctgcccggcctgggcggctatctcgcgagtggtggcgttcattccatattcaccaaactgcgccagtgcggcagcaatcagctgttttttcgcctgttcacccttgattgtcatggcaggattattcatcgcacagtccattcttaatcaaatgattgattaagattatgactccataggggagttgtccagtatggctaagaattttagcaacgccagtcacagggataatttatgcgctgcgtcacaaaaactgctacactccgctccctcatgacattgtggtttttgtcattttccttttcagtatctccctgaaaactacaccggtaacggtcggggcggttcggagtagttatgtctttcgattctttgggtttaagccctgatatcctgcgcgccgttgccgagcagggttaccgtgaacccacccctattcagcagcaggcgatccctgcggtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcgcagattggcgaaaacgtccgtgattacagcaaatacctgaacattcgttcgctggtggtgtttggtggtgtgagtattaacccgcagatgatgaaactgcgtggcggcgttgatgtgctggtggcaaccccgggacgtttgctggacctggaacatcagaatgcagtgaagctggatcaggttgaaatcctcgtcctcgatgaagctgaccgcatgctcgacatgggctttatccacgatatccgtcgcgtgttaacaaaactacctgcgaagcgccagaacctgttattctccgcgaccttctctgacgatattaaagccctggcggaaaaactgttgcacaacccgctggaaatcgaagtggcacgccgcaataccgcgtctgatcaggtgacccagcacgttcactttgtcgataagaaacgcaaacgcgaattgctgtcgcacatgattgggaaagggaactggcagcaggtgctggtgtttacccgtaccaaacacggcgctaaccatctggctgaacagctcaataaagatggcatccgtagtgcggcgatccacggcaataaatcgcaaggtgcgcgtactcgtgcgctggctgattttaaatcgggcgatattcgtgtactggtggcaactgacatcgctgcgcgcggcctggatattgaagagctgccgcacgtcgtcaactatgaactgccaaacgtacctgaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcggcggtcgtgggcaaggtggtggtcgcggtcaacagcaaccacgccgtggggaaggtggcgcaaaatctgcaagcgcgaaacctgcagaaaaaccgtctcgccgcctcggcgatgccaaaccggcaggcgaacaacaacgtcgccgccgtccgcgtaaacctgccgctgcgcagtaatcttttatgccgggctatgcccggcatcaggctgatgaacaaacgcaaaactgcctgatgcgctacgcttatcaggcctacgtgaactctgcaatatattgaatttgcatgcttttgtaggccggataaggcgtttacgccgcatccggcatttcacaacaagcacttgtcagcaatttgagaacacgggaaaaaatttatctgttttaccgcccataagccaccgagacgttacttctctatagccaattgttcgcgcaactccattaaaaggtagcccagtcgattcttgcccttaccatgaccaccgtctccccagtaagcatcgttttccgtatgctcaaccagttttgcgggcgcggttgccagcaagagcgcacgcagttctgcatgctgttcgaatttagcgcgaagtgcttttcgcatcacctgttctttgaccgactcccagtttttacgcagaggcttagaacgatcgcgccccatgcgtgcggcgaccataggggaagaaacccgacggatctcttcgcggtatttttcatcaaggaatttttgtgcctgaaaatagtgttctgaggtaggccaggttttcccgtcaaccttgatgggccaggcggcaaagttagaaaaatcaccgtagtcatcgctggtgctgtagaaatttatgatggtgtcttgcatgacgtgttggatcctttgtgctcgaacgggcattaaaccgcattatgttggtggttattgcgagccgctttccagaaacagaaaaaccattacccctgaaaaccgaaaaatgccacaatattggctgtttatacagtatttcaggttttctcatggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcgacatctggcgattgaagcccccaccggcgttgggaaaacgctctcttatttgattcccggcatcgccattgcccgcgaagagcaaaaaacgctggtggtgagtaccgccaacgtggcattgcaggatcagatttacagcaaagatttaccgctgctgaaaaagatcattcccgatcttaaattcactgccgcttttgggcgtgggcgctacgtttgtccgcgtaatctgacggcgctcgccagtactgaacccacgcaacaggatctgctggcgtttcttgacgacgaactgacgccgaacaatcaggaagagcaaaaacgttgtgcgaagctgaagggcgatctcgatacttataaatgggatggtctgcgcgatcatactgatatcgctatagatgacgatctctggcgtcgtttaagtaccgacaaagccagctgcctcaaccgcaattgttactactatcgtgaatgcccgttttttgtcgctcgtcgggagattcaggaagcggaagtggtggtggcaaaccatgcgctggtgatggcggcgatggaaagcgaagcggtattgcctgacccgaaaaatttactgctggtgctggacgaaggccatcacctgccggatgtggcgcgggatgcgcttgagatgagcgccgaaatcaccgcgccgtggtatcggctacagctggacttgttcacgaaactggtcgctacctgcatggagcagtttcgcccgaagaccatcccaccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcgttggggatgttcgaggcgcaaagcaaactctggcggctggcttcgctggcgcaatcttccggtgcaccggtgaccaaatgggcgacgcgggaagagcgcgaagggcagctacacctctggtttcactgcgtgggaatacgtgtcagcgatcagctggaaaggctgctgtggcgcagtattccgcacattattgtcacctccgcaaccttgcgttcgctgaacagtttttcgcgtttgcaggagatgagtggtctgaaagagaaagcgggcgaccgttttgtggcgctggattccccctttaaccactgcgaacagggcaaaattgttattccccggatgcgcgttgagccttccatcgacaacgaagagcagcatattgccgaaatggcggcctttttccgtaagcaggtggagagcaaaaaacatctcggtatgttggtactgtttgccagcggacgggcgatgcagcgctttctcgactatgtgacggatttacgtctgatgttgctggttcagggcgatcagccgcgttaccgtttagttgaactgcaccgcaaacgcgtcgccaacggtgagcgcagcgtgctggtgggcttacagtcatttgccgaagggcttgatttgaaaggtgatctgctcagccaggtgcatatccacaaaatcgcttttccgcccatcgacagcccggtggtgatcaccgaaggggaatggctgaaaagcctcaaccgctatccgtttgaggtgcaaagcctgccgagcgcctcgtttaacctgattcagcaggttgggcgactgattcgaagccacggttgctggggcgaagtggttatctacgacaaacgcttgctgaccaaaaattatggcaagcgactactggatgcattaccggtatttccgatagagcaaccggaagtccctgaaggtatagttaaaaagaaagaaaaaacgaaatccccacgccgtcggcggcgttaatgatgtgagtcaggtaaggagtcgtaaatggactatcgcaaaatcattaaagagatcgggcgcgggaaaaaccacgcgcgcgatttagaccgggatactgcgcgcggtctgtatgctcatatgctcaatggtgaagtccctgaccttgagttgggcggcgtattgattgcgctgcgtatcaaaggagaaggggaagcagagatgctcggcttttacgaagccatgcaaaatcacaccatcaagctgacgccgccagcaggcaagccgatgccgattgtcatccccagttacaacggcgcgcgtaaacaggccaacctgacgccgttgttggcgattctcctgcacaaactcggttttcctgtggtggttcacggggttagcgaagatccaacccgcgtgctgactgaaaccatttttgaattgatgggtattacgccaacgttgcacggcgggcaggcgcaggcgaagctcgacgaacatcaaccggtgtttatgccagtcggcgcgttttgcccgccgctggaaaaacaactggcgatgcgctggcggatgggcgtgcgtaacagtgcacataccctggcgaaactggcgacgccatttgccgaaggtgaggcgctgcgtctttccagcgtttcgcatccggaatacattggacgcgtcgcgaagttctttagcgatatcggcgggcgggcgctactaatgcatggtactgaaggtgaagtgtatgctaatccgcagcgctgcccgcagatcaatctcattgaccgtgaagggatgcgggtgctgtatgaaaaacaggacactgctggtagcgagttactgccacaagcaaaagatccggaaaccacggcgcagtggattgagcgttgccttgctggcagcgaaccgattcccgaatcgctgaaaatccagatggcttgctgcctggtggctacgggtgaagcggcaactatcagcgacggcctggcgcgcgttaatcaggcattttaattcttttctcagccggatgagccatgtcatccggcttttaccccaccgcaatatgaaattcctgcatctttattgaccttcccacgcccggcgtgcagcataaaaatacaacaaacacataacataaacaggagttaaccatggaaagtggtcatcgctttgatgctcagacgctgcacagttttattcaggctgtatttcgtcagatgggtagcgaggaacaagaagcgaaattagttgccgatcatttaatcgcggcaaacctggcagggcatgattcacatggtattggcatgatcccaagctatgtacgctcctggagtcaggggcacctgcaaattaaccatcatgccaaaaccgttaaagaggcgggggcggcggtcacgctcgatggcgatcgcgcatttggtcaggtcgcggcacatgaagcgatggcgctggggattgagaaagcgcatcagcacggtattgccgccgtggcgctacataactcgcatcatatcggccgtatcggttactgggcggagcagtgtgcagcggcggggtttgtctctatccactttgttagcgtggtcggtattccaatggtcgcgccgttccacggtcgcgacagccgctttggcaccaatccgttctgtgtggttttccctcgtaaagataatttcccgctgttgcttgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttccggcggtaaaacgacgcatcaggaaacgttacaaaccagtcccgatgccattcttaactgcatgaccactatcatcatcaacccggaactcttcggcgcgccggattgtaacgcgcagaccgaagcctttgccgagtgggtgaaagcctcgccgcatgatgatgataagccgattttgctaccgggcgagtgggaagtgaacacgcgtcgcgaacggcagaagcaggggattccactggatgcgggaagctggcaggccatttgtgatgcagcgcggcagattggtatgccggaagagacgttgcaggctttctgtcagcagttagccagctaaaaaaaagcccgtccagtggcggacgggcaaacaagggtaacataggatcaatgagggttagagcatatgcgtctgtcggcaaacagacagggaaatacttgtgctggacgtagcgtaaacgcctgatccgtccaacggttcggattttgtaggcctgataagacgcggtagcgtcgcatcaggcatctgttgccggatgcggcgtaaacgccttatccgtcctacgaattacttataaattaccgcagtaccgcttaatttattgttgttggtggcggaagtgatgctgtatccactggcaccggctgccgcggctttctcagccagtttcgcttccagggcatcgagggtggatgcgccatcggcagaaaccacgccgattttattcatgttctgtgcctgggatgccgttaccggttccgccgcgaacacgccaaatgacagagttgaaagagccatagcagcaacaacagtattgatagttttcataattaatctctcgcaggtgatttttgtataagtgacgttgtttcgtcgatgtgatgagtatcacgtttttttacgagagataaaatcgaagagaattgaccgccttgttcaaataaattgattgatatctaacctactgataaaccatttatttgttgtacttatgaacttgttttataccgcgtggcagtcacagcagcgttaaaggcacggaatgacacgcaaaatacaaattatactcgctatgcatctcgccagttgtagttaacgtaactggctgtctttcgaacctctgcgattatatcctgtataagctggtttttgtaaatctttctcctgctgacaatgaatacataagcgcacgccaggaatggcttcccgacgggcctgcgggatgggggcaccgcactcttcacattcatccaggctttcgccgcgcggaatttcaccccgagcgcgggcaatcgcatcttcaattgtactgttgatctgttcgttgacggcgtcatcgttagcccaaccggatgccatatcgacctccccatatcaatacttgtacagttaagtgtagctaatccagggacgaactcgggcagttcaagcatcagatctccgaccattcccgcagcagattatgataaagattaagcagcgacaggatctcttcactttcgccgtagcggcttttcagcgactgaatattgttgtccagttcaaacagcatggcgcgctttttatcatcgcggatcatcgactggatccacataaatgatgccactcgtacgccgcgggttacgggtgtcacgcaatgcaggctgctggagggatacaacacgagatcgcctgccgggagttttacccgatgttgtccgaaggtgtcattaacgaccagttcgccgccgtcgtagctttgtggatcgcttaaaaacagcgtggcagaaaggtcagtacgcatccagccgttttgtggatggctgcgtactgcgccatccacatggaaaccataggtttcattgttctgatagcgattaaacagcggcgtggaaagggtacgcggcaaggccgcggcaaagaataaagcatgttggttaaccgcgttcagcacctcattttgcagggcggcgtataacgtgctgcgggtgtcgacctgttgattgttcttaacttgcgcaccttgtgcgccggtggtgacgcgtccatccacccattcggcttgttccagttgttcgcgaaaacgagcgacgtcctgtggcgataacacgccgggaatgtggtacatcatacaatttctccaaaaagtggggcctgcgccccacatctgaatcagaaatgcatattggctgtgagcaagaaggttcttggctcgcccgggtgataacggtagccgctcttgttgattgaggcgacgtaatcggtatcaaacaggttgtaaacgtttagctggaagtcgagattgcgattaactcgataccccagtttggcatcggcgacccagtaaccttcggtaaacgctggcgttcccaccgcgccgtctgaacctttatgcatactgccgatatagcgtgcgcccgcgccaacagagatatcgtcggttgcctgatattggctccataaggtgaaggcgtgctccggggtatacggcagcgatgaggaaccatcctgggcaacatctttgccgtttttgatggttgctttttgctgggtatagccgccaatcacctgccacgcgggagtgatattcccggccacggatatctcatagccttcgacgcgtttcttaccgtattgcgagtaagttccgtcatcattttgctcaacttcattttcgatatcagtgcggaacagcgcggcggtgagcaacagacgtttatccagaacctgccatttggtgccaatctcgctggtgttggctttttgcggtttaaaatcggtgcggttggcactgttaccgctgccagactgcgcaagggcgaagttgttgccgcccggaggctgctgggaaacggcatagttaatatagacattgccgttttccgtcaggtgatacagcgccccggctttccagttcatcagattgcccgacttggcggtgtcgacggtggtgaccggagaaccttttgccacaccagttgggcaggtgatggcaccgcgtccgctgccgccgcaggcggtggcactgtcatattcagtatgataattatccagacggatcccgccgttcagctcaaaatcacgggtgatttgcagcgtatcaaaggcgtaaattgcgaaggtatccgtctgaccattggcgtttgcgccgttgcgcgtcaggccgccgggatgaatgctgctgtcaggatgataaatatttaccgcgggtaacgtcaccggattaacgccgtagttagtctgcgtttcacgggtaaattccacgccggtactgacatcatgaccgatagaaccggtatagaacgtcgaggtcaggttggtctggttggtgagaattttattactcacatctttggtattcgccgtgcgtgaccaggtccagctattcacatcgctggtgggctgagtaatattcgacgccccgcccataatcgccgtcatcaggtaatcctgctttacgcgcgaccaacgggtagtattgcgaatggtggtgttatcgttgatgtcgtgctcaaaacgcatggtggcggtgtcggtggtcgaatcgtcgtaatcggaatccgtgccgtaaaagttatgagtatcaacttttccggaatgattcagggccgccgttcccgcagatggggcagaatagcccggcaaaccgatggtcggaatgccgccgtctggcgtgttgtgctgggtgacatgcagataattaagatacaaacgattcgctgtaccaaggccaaaagcgacagaaggggcgacgccgtaacgctcatttttgactttgtcgcgtccggcatcgtgcgttttttcgcccattacattcaggcgcaccgcggtggtatcaccaatgacctgattgacgtccagcgtgccgcggcggaaccaggcgctgccaatactggcggaggcgtcaatgccggaatcattgcgcggctgcttgctgatcatattgatcgagcctgtcggtgcgctgcgcccgtagtcggtgccggacggccctttaatcacttcgacctgctcggtattgaaggtgtcgcgcgagacgctgccgatatcgcgaatgccatcaatataaatactgttagaggtatcggcaccacgcatataaatggcgtcgccagtggtggagttaccgttctcacccgcaaaaaacgcacccacgccggggacgtttttgagcgcgtcggtaaggttggttgcgccctgatctttaatcacttgttcagaaattaccgtcatcgtgcgggtagtatccgctaccggacgcgagaatttcggatcggcagattgttgtggcgcataaagcgaaggcgttgatgcttcgacaaccagcgtgtcatccgcgttagtttgcccttcggcggcgagtgcctgagccacaggcgtgatgccaatacaaagaccggcaaagaacgtgagcgaatgaaattgtctggcagggaaattgcgattgttttccattttgcaggtgactttttcttatatgttgaaattttcactgccacgagaaagcctctctgcggatgcgatgccactgttaatcccgtgatagtgctcgtgaaagtgataataattttgataagcattatcacttggagcgattttctatcacccattgcgcgaaaaagaaatacatttatttacattgagttcatatttgatgttttttgattacaaaacagacgaaaactgcatccagaggcgaatgcagttacgttggtggggttatttgtagatggttgcagtaccgaacatctggtcatttccgcctgcggaattaatgacataacctttcgcgccttgttcgcgcgctttttctgccagtttatcctccagatcgcttaggtttgatgcgccagttgccgaaacggtaccggcgggccgtagctgaccgctgtccaggttactcatcggttgcgcggcataagccgtgagagagattccgctcaggacggtggcaatcagtagtgtgaggcactttttcataatgacatcctcataaatacaacgggtagtgcctgataagtgtaggtcgcctgcgcgatgcaaatgacgcaaaaaattgacagagatgtgcttattttttgaacgatatatttttacaaaataagacaaatcaatgacatgcataatgctgatttttatgatgaattgccataaaccatagccatgttaaggttttggggaatgataaacgcagccagatatttaccctgtcgcgttatgcgggtatcttacgccgctgcttaaaggagaatgctatgtccgcccagaaaccggggttgcatccgcgcaaccgtcatcacagccgctacgatctcgccacgctttgtcaggtcaatcctgaactcaggcaattcctcacgcttacacccgccggggagcaaagcgtagactttgccaatccgctggcggtgaaggcgctcaataaggcgttgctggcccatttttacgccgtagcgaactgggatatccccgacggttttctctgcccaccagtaccgggccgggcggattatattcatcaccttgccgatttactggcagaagcaagcggaacaattccagcgaatgccagcattctggatatcggcgttggtgcgaactgtatttatccgctgattggcgtacatgaatatggctggcgttttaccggtagtgaaaccagcagccaggcgttaagcagtgcgcaggcgattatcagttctaatccggggcttaaccgcgccattcgtctgcgtcggcaaaaagagagtggggcgatttttaacggcatcatccataaaaacgagcaatacgacgcgaccttgtgtaacccgccattccacgattccgccgctgcggcacgggcaggtagtgagcgtaaacgccgtaacctggggctgaacaaagacgatgcactgaactttggcggccagcaacaggagttgtggtgtgaaggcggtgaagtcacctttatcaaaaagatgattgaagagagcaaaggcttcgcgaagcaggtgatgtggtttacatcactggtatctcgtggtgaaaacttaccgccgttgtatcgtgccctgacggacgtgggcgcggtgaaggtggttaaaaaagagatggcccaggggcaaaagcagagtcgctttattgcctggacctttatgaacgacgagcagcgccgccgttttgtcaatcgccagcgttaaagcgttggttcccccggcggtaacggttcagccggggtcgcgcccggagcaggcagcacctgataagtctgcactggcgcgcgaacgcccgccaggtcgaaatgttttttcacctggctgtcgagggcaaagcgtaccgtccactgtttgagtggcagcgtggtgaacgaaacacgcagtgtaaacgcggtattgcttaagccgacaatcccggcaaaattcggttcaccaataatcagcccgcgaatttcttcgttttccattaattccgctaccgcatctttcagtgcctgattggctttatcagcatcttcatggcgatcaacatcataatttgccaccaccgaaccaatgccgcggacaaagttagcaaaggtggttatcgaagaccacggaatgatgtgatacgccccggtatcctgtcgtacgcccacggagcgaatcgacatccgttccactgtgccggtcaacggcccgatagtcaccaaatctccagtgttcatgccgttttcaaactgaataaataccccggtgataatatctttcaccagcgtttgcgaaccaaacgagatagccagacctaatgccccggcacctgccagcaatggcgcgatattgacgccgatttccgacaacacaatcatgatggtgatggtactgataatcaccgccagcgcgttacgaaacagcgtaagcagggtacgcgtgcgggcgctgggtagcgggcggccatgaatatccgaagccagccggttttcgatcaaactggcgagcaccgtccagccaaccgccgagaagaaaagaatgagtgcgatacggatcaggatatctacggttttctgccccgcgccgttttgcagccagttccagaaatcgaacaatccccatgcgctcaacagcaacattaccgccacgcagactgtcagaatacgcgccgttttcagcgccgccgacagccagccattcaaccgtttttgcagctccggatagttacgctgagtatgtggcgagagagtgatggttttcgccagccagcgggaaaacataccggaaacaaacgctgcgataccaataatcgccaggctgcgcaccgttgcacccatcataaatttcaggctgttgcccggatcgaacaacgaaaagaaaaacagcacgataaaataggcgcttgccagccagtgccacaccagcgcaaaggcgcggataaacaggctgaaaaaggccagcgaatgctccgcgaagttgagcaaatgctgggtaatctcttttttattacgaaagatcaggtacaacgcccagacggtcatgcacagcataatgatgacgttcgccagcgcacctatctgtacattcacctgattagagataatcggcacggccacaatcaggccataacctatcaaactgcttaaccagctcaggcgacgactccagtaacgggcgctctcgtcctgaatcgtgaacgggcgcagctccgccacgtttgggcaaaaaatcaggcgtagtacggctttgaaaaattcaatgagggcaaaggcgttgagaaacaaactttgttggaaagcgatggtgcgactgcctgcattcaggttgtcgcttaatacctggccgacaaataatgtcagggccagtaacagcaggtcgataataaacgccccgataatcatcgccggaagctgcaaccagttgctgcgctcacgatttttttgccgcgcccactgacccattttgcgatacagcggcagtgcgcacaggcgaatcagccagtaaaaaccaaacactaataccgctaacattgaaaaatgggtcagcgcattgctgaaggtttgtggattaaacggcttatgcggggagccggtgatattgcgataaagttgcccgaagcgggcggaaagggcttcaccataatggcggctgacttcggtgaccttttgcagcacggtttgctcttcgaccagcgtcggcggcactatttttggtaccggttcagcagggggcgtagcggcaacggtgcgcaactggtcgatcaactctttacgcgaggtgtcattatccagcacatccgccagtgcgccataggccgcttttttttgttcgatatccggttccggggccggttcagtcgttgagtccgttgtcgttgtggttgtaacgccgggtatggataccgcgtgggcaggtgcgcccagcaggcagaagaggatgaacaggatccaccgcatgactcctccagtgagaaaatagagcaaaaagataagtatagatgctggaggaggggcgattttaaatgagaggaatctggtgtgcctccctttcgggtgaaagggaggaagggatattaagcaggttgctgacaacgtgcgggcttttttgccggatgcggcgtgaacgccttatccgtcctacaagttcatgcaattttaataagttgccagatatcctgtaggcctgataagcgtagcgcatcaggcaatgtgtcttattaagagacgtgctgcaaaaattcctgcaagcgctggctcggcgggttcttgatcaacacctgcggattgccatcttccgcaatccggcctttgtcgataaagatcagccgcgaagctactttctcggcaaaaccgatttcgtgggtcacgatcaccatcgtcatcccttcttcagccagatcctgcataaccttcagcacttcatggcgcagttccgggtcaagagcggaagtcggttcatcaaacagcatcattttcggcttcaccgccagcgcgcgggcaatcgccacacgctgctgttgaccaccagaaagttcggaagggtagtgatgtgcacgttctgccagaccgactttcgccagcagctcacgtgccagtttttccgcctcttctttgttcgcgccacgcacgcgtagcgggccaaacatgacgttttccagcgctgtcagatgcgggaagaggtaaaactgctggaacaccatacctgcttcctggcgaatcaggcgctcgtcaactttcggatcgttaaccttcaggccatcgacaatcagatcgccggaggtgatttcttccagtttgttgatgcagcgcagcagggtcgatttaccggaaccggacggcccgataatcaccacgacttcgccctgggcaatgttcaaatcgatattgtgcagcacctgggttgggccaaagtgcttggagacgtttttaaattcaatcacaggattttcatccttctttccagacgacgcagaataaagctcagcaccagggtaataatcagatagaacaccgccacggcgctccagatctcaagggcgcggaagttaccggcaataatttcttgcccctgacgggtcagttccgccacgccgatcacaataaacagcgaggtgtctttaatgctgatgatccactggttacccagcggcggcagcatacgacgcagtgccagcggtaaaatgacgtagcgaatggtttcccaacgtgaaagaccgagcgccagtcctgcttcacgaaaacctttgtggatagacagcaccgcaccacgcgtgatttccgcaatatacgcgccggagttgatcatgatggtgaccaccgccgcagtaaatgggtcgatgcgtaagtcgttaaacgccatcggcagggcgaaataaataaacatcacctggacgacgataggtgtgccgcggatcacttcaataaagaccagcgcgacgtggttggctatccaacctccgaaggtgcgtgcaaaacctgccagcaatccgattaccagaccgcctgccagaccgaggaccgaaatccacagggtcattttggcaccttcaatcagaagcggaatggcaggccagatggcactccagtcaaactgcatatgttgttcctgttaccgtggtgtaaataatcaaattcagggtaattaatggccccggagcgggtttgcgcccctcaccctaatcctctccccataggggagagggaactgccagtgcgttttacaggtgtagcgttattatttcggttcagtaccgaaccattttttgtagatttcgttgtaagttccgttctcgcgcagggttttcaacgcgccgttgactttgtcacgcagctcgtcgctacctttcgggaacgcaataccgtattgctgcgcttccagagagtcacctaccgctttgaactgaccgttaccggcggttttgatgaagtacagaatgtttggcgtatcgtgcagaacggcgtctgcgcggttggtgcccagttccatataggcgttatcgatgttcgggaactgacgcagatctttagttttgatgtttgctttcgcgtaatcaacggagccagtaccgctcttcacagcaaccactttcccgtcgagatctttcacgcttttcacatcgttattgttagctttcaccatcactaacaggccgcttttgtagtagccgtcagagaaatcgatcgcttttttacgctcgtcggtgatggtaatgcccgccagcgccagatcgacgtttttggtttgcagtgccggaatgatcccactgaaatccatcggcttcagttcgtaatccagcttcagctctttagcgatggcagcccacagatcaacgtcaaagcccacatatttatcgccctgtttaaattcaaacggaacgaaggcggtatccgtcgcgacaactaattttttatccgcggcatgagaagaaaccgcaaaagccagggtcagtgcagccagtgaaacttttaatacagacttcatagcatttccttttttctatccacgggacgatcccctgcgtgacattcacatatatgaaaaaatcgtgccagttttgcaactccttgatttttcgagatgcggcaaaaacgtgatgcacgatttatagggcaataccctgaagatgcaccattctggggcaccaatctggtgcgctaaaattgtgcactcaacacagtgattatttagcgtaaaacctgatgaaaaaacaatctttatgtaacgattgtgtgatgatgtggatacaaaaaatttacttaatcagctggagatagcagatggatgcactaaataagtgcgttgaggtgggctgcaaaacaaaacggcctcctgtcaggaagccgcttttatcgggtactaaagttctgcaccatcagcgatggatttattcgatgttagactcgataaaccacaggaatttatccaggtcgcgagacgcggcggtcaggatatctgcggtgtcgtcatctttcgcttcgccaatcgctttgcgtacgtcattagcgacgattgcgtaacggtcagccagttctttcaggtgatcctgaacgttgtggatgtccagcgggtaacttttcagcggggttttgctgttgataacttgagtggtccccagagctacaccgcccagctgcactgcacgttctgccatggtatccagatgatcgatcagtgcggtgcggaagccatccagcatttcatgtacggcaatgaagttagcgccgcgcatgttccagtgcgcttgtttggtaatcaaagaaagatcaataaactggataacctggcgattcagcaactctactgttgcttttttctcgctgtcggagacatcgttgcgggtataaagcagattggtcgcttttgatttaactaatttagcggtactcataatttcatatcctcttgatgttatgtcccagtaattaacgagattaagtatagcaccggctatgtgttccgctattctggctgttcctatcacactaatagtggtaacaagcgtgaaaaacaaaactaataaagattcaatgagttagatatattgataagaacaattcttatttatctgctcgccaggaattttcggaataaatatgcttttgcataattcgatatataaagacggtgtagaggaaaagtagcgagaaattctgcatggttatgcataaccatgcagaaatgtaaatttaattaatgtctaattcttttattttgctctctttgcgtactgtcagcgtagaccccattgaagcggcgatgatagcgccgagcgccagtagctgtatgggtgtcagtgtttctccgaggaaaatcatcccggaaacggcagccagcgccggttccatgctcatcagcgtaccaaatgtccgtgttggcaaacgggtgagggcaatcatttccagcgaataaggcagagcggtcgagagaatagcgacagccagacccaatggaataaccgaccagtgccagagtgcttcaccagcctgaagcgctccaattggcacgaaaattaacgctgcaatcaacgaaccaattgccaccgtcgcagggccatgttccgctcctgcgcgttgcccacttaaaatgtaaatagcccaacaagccccggcccccagtgccagcgcacagccggttaaatcgacatgggaaacgtcttgccccagcggtagcaggaaccacagaccaagaaccgccagcacaacccagacgaaatctaccgggcgacgagaagagaacagcgccaccgccagtggtccggtgaactccagcgccaccgcaatacccagcggtactgtctgaatagaaagataaaaaagataattcatcccacccagcgaaacgccgtaaaacaacagcggtaaccgttgctctttggcaaagcgcagtcgccatggcttaaagaacgcgatgaggatcagcgttcctaatgccagacgcagcgcagtgacacccggtgcgcccaccagaggaaaaagtgacttagctaacgaggctccaccctgaatagacgccatggcaacgagcaatatgactattggtaaccagaccggcattttacgtaatgaaccaggcatcctttctcccacaaatatctagacttaagtaaagcgtggagtgtactggatatacccaatgctggttgagcatttgttgaaaaaattttcccccgttttgactaaaatgcgccaggattgatggaatcattagtctggtgattaggaataatctggatgaatgacagggaaaacatgcgtaatacttacgcagttctctgaaaaagtgatttaaatttagatggatagcggtgtatggaaacgttctgttacatgaaatggcccgttagacatcacaaatcgcgaagagtttcccattaatttttgatatatttaaaacttaggacttatttgaatcacatttgaggtggttatgaaaaaaattgcatgtctttcagcactggccgcagttctggctttcaccgcaggtacttccgtagctgcgacttctactgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgcgggtctgcagttcaacccgatggaaaacgttgctctggacttctcttacgagcagagccgtattcgtagcgttgacgtaggcacctggattgccggtgttggttaccgcttctaatcactttggtgatataaaaaatccgcctctcggggcggatttttgtttttaaggtttcgggtcgaaaatatcggttccgagatggttgtaatccaccttctgtaactggaagttggtgatgtatatcggcccggctttcttctcagatataaacgggtatttgatgttaatttccttcgctttaatccccgtccactgggagaaaaagcctaagaagtcattggctgagcggcgggctttaatcacacgatgcgctttatcgtcgctggaaatgaccataaaaggcacctggaaattttgctgatatttatcatcatgggcaaggtattgcacgtctttaccgcgctctttaaaggccagaccgtggtcagaaaagtaaaccagcgagaagctgctgccgctgttgcgtaactgatcgtacagcttgcgcagtaaatcgtccgtttgcgtcatggtatagagatagcacgacgtttctttcgattgcacaaaggtttcgtattttccttgtgtcctgtcgcaggcctgcggatgtgagcccatcagatgtagaacaatcagctgcggttgcgagtgctcttgcgccagcacttgagcggtcatatccagtaacgcttcgtctttggtgtttttatctgcttcaaaattaccttctttcaggaagtacacttcatctgctcgtttggcgatgctggcgatagcggtatcgtattcgccgatttgaccctggttggaaaaccaccaggtctggaagcccgcgcgatttgccagggtgacaaagttatcctgaaactgtggtttgccatcgacaacgcgattgagcgttaagccaagcgatttctgcgtggagccactggcggcaatgtagtcagcaaatatcaaaccgttaacgctgctggcaaacggggtattgtcccagtgaccgccaaaggcaccgagggcatcgcgacgcgcgctttcaccgatcaccaccacataggtctgatacttcggcttaacggcagtgaccgtccaggtatctttcattccggaaagttttgccatccgttcttgctcttcaatcacctcgttattattgacgatgacatccttagcaaaacgaaataccggatagccagtatctttcagtttaaatacgccaccccaggccaggttttgcacgggagcaacaaaaaatgtcgccacactgaataccagacacaggctgtcgaaggtattccagcgcgctttttcattctctttttttcgcctgattgctattacgccgagcgcaaaaataaataagccgaccaggtagctgtaccacggaaaaatcgtcaggatttcggtcgactcttccatattggtggagtgcaatgccagcaatgtattgaaattaggcgcgccgtaggcctgagcaaaagggaaataacaagccgccaccagcgaactgacaccgaccagaactttttgtacgcgaggcaatgttcgccatagcaaaagcaaaatagccgtaaacgcagcggtgtagagcaaactgaaggggtaacctaagccgaggttaattaatagcgactgtaaaaagtagaacgcagtccacgggctaaatacccggctacgggtaacaagcgattctttgagggttaaattcatatgccactatcgtaacaaacgccatgtgcttaccctggcgtcaagggtcaatacctgcaagagtgcgtgaagagtggaaaggggtccgcatccgcgagccgcaatatacgcagggctgcaagaagatagagcgagccgccgttcaggtcaactactgacgaacaaatcttttgcgaaggggattgcaaatccgacaaaaagtggggtttttcagaccaaaacgcgttatgcctgcatgaaagcaggagtgaagcggcgtaccgcgacgccgctatttatcggaaggtttatcttgctgcggtttgttgttgaccatatcgcacaacatagagagcagcattaaccgtactttaaagggagaatgactaaacacgcgcatacacctcttgaactcattcataagacctcctgacttgctaatcccgtcgatccttgagggatgattgcattacatacagatatagcacaggctatattatatagctattgctaaaacgttaattttttgtaccttcgcaactctggtttacaatgtgcgcacgaaatgagaacgctatgtatgcgtcaccataatgaggaagcacaatgagtcgtcgcgcaggtacgccaacagcaaaaaaagtgacgcagttagtgaacgtggaagagcacgttgaagggttccgccaggtcagagaggcgcatcggcgcgagcttattgatgattacgttgagctgatttctgacttgatcagggaagtgggggaagctcgtcaggtggacatggctgctcgtctgggagtttcgcaaccgacggtggctaaaatgcttaagcggctggcaaccatggggctgattgaaatgatcccctggcgtggcgtgtttttaacggcagaaggagagaagctggcgcaggaaagccgcgagcgacatcagatagtcgaaaatttcttgttggtgttgggcgtcagtccggaaatcgcccgtcgcgacgcggaaggcatggagcaccatgttagtgaagagacgctcgacgcttttcgtttgtttacccagaaacacggtgccaaatgagcctgccttttttacgcacgctgcaaggcgatcgtttttttcagttattaattcttgttggtatcggattaagctttttcgtgccctttgcaccgaaatcctggcctgctgctatcgactggcacaccatcatcaccttaagcggcctgatgctgctgaccaaaggtgtggagttaagcggttattttgatgtgctggggcgcaaaatggtgcgccgctttgctacggagcgtcggctggcgatgtttatggtgctggcggcggcgctgctttctacctttctgaccaacgatgtcgcgctgtttattgttgttccgctgactatcacgctaaaaagactgtgtgagatcccggttaatcggctgattatttttgaggcgctggcagtcaacgctggttcgctactgacgccaattggcaacccgcaaaatattcttatctggggacgttctggtctttcgtttgccggatttattgcccaaatggcaccgctggctggcgcaatgatgctgacgctcctgctcctgtgctggtgttgtttccctggaaaggcgatgcaataccatacgggggtgcaaacaccggagtggaaaccgcggctggtgtggagttgtctggggctgtatatcgtctttctgacggcgctggagttcaaacaagagctgtggggactggtgattgtggcggcaggctttgcgctgctggcacgtcgcgtggtgctcagtgtggactggacgctgctgctggtgtttatggcgatgtttatcgacgtccatttactgacccagcttccagcgttgcaaggcgtgttgggtaacgtgagtcatctatctgaacccgggttatggttaacggcaatcggtttatcgcaggtgatcagtaacgtgccgagtaccatattgttgctgaactatgtgccgccgtctttattactggtatgggcggtaaacgtaggtggctttgggttattacccggatcgctggcaaatttgattgcgctacgtatggcgaacgatcgccgcatctggtggcgtttccatctctattcaataccgatgctgttgtgggcggcgttggtgggatatgttttgttagttatactcccggccaactagggtctggcaaataaaaaaggcggattatgagtccgccttttgctttaagttttgaagattaattcagacgaaccggcatcccggagcggtttttaatcgcttcatcaagaacaacctggtcaacatctggctgaccggtcactgtctgcacgctcttcgtcagggtaattggcacaatttcctgaccttcaaactgggcttcggtggtagacagcgggttatggacttcaatataacggctgccgtctggctcggtggtcgcttttaccggctcatcaataaactgtacgcgggtaccgaccggtactttctcgaacaggaatttgatgtcttcgttacgcagacgcacacaaccatgacttacacgcaggccgataccgaagttggcgttggtgccatggatagcatacaggcgaccgatatagagtgcatacagccccatcgggttatccggacctgccggaacgacagccggaagcggttcgcccgcagcgcggtactctgcgtgcattttggcggtcggcgtccaggtcgggcctgcttttttacgctcaactttggtggtccagttgataggcgtatctttgcctaactgaccaatgccgatcggcagcacgataacggtgttggtccctttcggatagtaataaagacgcatctcagcactgttaatgacgatgccttcatgaacggtatccggcaggatcagctgctgcggaatgttcagtacagtaccgcctttcggcaggaaggtatccacacccgggttcgcttccatcatattggaaagccccatctggtactcggcggcaaaatactccagcggctgagtgttaccttcaggaatggtgatcacctgattctgaccaaccaggcgactcccgtcggttggcagaggataagttaccgcagaggcggtactgcaaaagccgacaacagcgaaggccgctgcgaataatgttttcaatttcatattcatgttaagcgagattttgtgcctggcaggccattgggttgagaatattagagtattggaagcgcattataagttcattccagctcacagtgaaatcagatgtgtacgaaatcacattttttgcctttggcttgagtgtagaccttaagcgaggagcaggatcttctttcagacttatggcataatgcgcggtttgtcatatctcttttcaggatacgcctgtgttagtttccagtaacgtcaccatgcagttcggcagtaagccgttgtttgaaaacatttccgtcaaatttggcggcggcaaccgttacggcctgattggcgcgaacggtagtggtaaatccacctttatgaagatcctcggcggcgaccttgagccgacgctgggtaacgtttccctcgatcccaacgagcgcattggtaaactgcgtcaggatcagtttgcctttgaagagttcactgtgctggatacggtgatcatggggcataaagagttgtgggaagtgaagcaggagcgcgaccgcatctatgctttgccggaaatgagtgaagaagacggctataaagtggccgatctggaagttaaatacggcgaaatggacggttactctgcggaagctcgcgccggtgaactgttgcttggcgtgggaattccagtggaacagcactacggcccgatgagtgaagttgctcctggctggaagctgcgtgtgcttctggcgcaggcgctgtttgctgatccggatattctcctgctcgacgaaccgaccaacaacctcgacatcgacaccattcgctggctggaacaggtgctgaacgagcgtgacagcaccatgatcatcatctcgcacgaccgtcacttccttaacatggtctgtacccacatggcggatctggattacggcgagctgcgcgtttatccgggtaactacgatgagtacatgacggcggcgacccaggcgcgtgaacgtctgctggccgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaaactgttccgtaacgcgctggaagtggaaggtctgaccaaagggtttgataacggtccgctgtttaaaaatctcaacctgctgctggaagtgggtgaaaaactggcggtactgggtaccaacggcgtcggtaaatcaacgctgctgaaaacgctggtgggcgatctgcaaccggacagcggcaccgtaaaatggtctgagaacgcgcgcattggttactatgctcaggaccacgaatatgagtttgaaaatgatctgaccgtgttcgaatggatgagccagtggaagcaggaaggcgatgacgagcaggcggtacgcagtattctcggtcgtttgctgttcagccaggacgacatcaaaaagccagctaaagtgctttccggtggggaaaaagggcggatgctgtttggtaagttaatgatgcagaagccgaacattctgatcatggacgaaccgaccaaccacctggatatggaatccattgagtcgctgaacatggcactggaactgtatcagggcacgctgatctttgtttcacacgaccgtgagttcgtaagctccctggcgacccgcattctggaaatcaccccggaacgcgtgatcgactttagcggtaattacgaagattacctgcgtagtaaagggatcgagtaagtgattatccgtcaccccgatactgtcggggtgacggcggctgatgacaaatgcaaaatagcctgatgcgctacgcttatcaggcctacgcagtacctgcaatatattgaatctgcaggactttgtaggccggataaggcgttaacgccgcatcaggcattaacaaagcgcatttgtcagcaatctgagtaacgtcgaatcgattttcttaatcccacatcaattcacttccattaattctcaaacatccatgcccaacgctcgcttaccgtgaatgttgaggtcggcaagcgtaaagcgtccttcccagtttgtttcatagtcctcgcgcgggaagtcgcccggcgatgcgcctttttccagtgcggccttcaccttgtgcgcgtaggcaagatttttctcgcacatcggtgccgcaggaatgtacatcacgttgccccaaccttgttgattttcaacgggggcaacggaatggatgacgtcgcagtgccaccagacggagtctccggcttcgagttttggaatgctggttaacgcctcaatcaacagtggatgccattgctctgataccggcaatactcttccgggcgctacgccgcacagttcatcctccggcacatcatcaagcagcggacgtaacagtacgtacgccatagcttcaggaatgggcacgacgtgcagcagcccctgaccaggcagcatatcagagagcgctgtccagccctggaatgtccgaaacacggaacatttggtggtgttgtccaccgtgtactcttcaacttccgtacgatgtgccgcatgccagggatcatattgcgccagattgccattaaagacgttggcgaaaacgcgctgatacgctggaagcagccagcgttccagtgccccggagtcggtatgcgctccaagacctttggaggtcgttccgggcggacggcggcggatacggtcagggtagatgacgctcacatccgggttaaaccattgctttccatcactttcaaatgtccacagacgattgagaaacgactgcgcattcgccatttcttcactctggcgggcctgcatttgcgcctgcgaccagtagatggggtaaatctcgggacgtgaagcgctgagcgtcccgaagaaattatcgccggggcctttgtagacctcgtcaaagcggttgcggtccagatagtccagcatcgactgatcccagcctagcgcttgttcgcgggggaaatggccttttatcaccgcacaaccgcgacgtttaatctgttcgcgctgctctgcagtaacatgacctgctttgatatcggcataagacagcaccggccagacggcatcgccctgtgctttgagtgcgttgatttcagccactcgcgtggcaatgtcatcgcttagctgattaaagatctgctggacgtcgccaagctgcgcccgcagcgcgtgcttcatctgacggatagctgctttgtgatcggcaggcaatgtgtcgctggtaaaagtagaagccataaccacctctcattaactttcattcgaaaccattctgatttgcatgtgacaatataagttataaataagttaatgcaagtttaatgatttgatgtgatgtacaggatgtaaaaagaagggaaaaccggagcgcacggctccggtagagaggtcagctgttaaaaggggatgtgttatccagcaccgcctgaatcacattcagcgcgccttcatgattattatcatcggtagcgtaacgggcgatttgtttaatgttttccgcagcattgcccatcgcaaaggaataacgcgccattttcagcatctccgcatcgttaccgctgtcgccaatcgctaccacattttgcggtgacagatcccagcgtttcagtaaccgcgaaataccgtttgctttatgtagaccgggaataatcaggtcgataaagccaaaaccactggtaacgggtttcataatgccatcgagcgctacgtgcagtttgtcgatcactaacgggatttgttcatccggcaggttgagcgaaaacttgaacagtacgtcgtcaatctcctgataatcttttacaggtttcaggcgatggtagtgttttgccatcagtgcgacaaatgcttcgggggcattttcgctgacatatgcactttgcagaccgcaggcgacaaaattgagttgcttatcttttagcaactcgccaataacaatccgcgattcatgtcgggtcagttcgccgtggaacaactgcttgccatgttcgtaaaccagtgcgccgttttccgcgacaaaagagatctcatcctttagctcaggaaagaatgaaataagctggtaatactgattaccgctggcaacaacgaacttaatgccgcgctttttcagttcctgatattgcgccataaaacgtggttggttgtacgttttggcgtcgttaagaaaagtaccgtccatgtctgtgacgataacttttacgctcataggtgtgctcctggctcgaaaatgaaaccgtaacagtgtaataacaatgtgacgcagagcacaaattatatttcgaatgaaagtaaggatgaaattgatgatgtgaatgatttagcccggcgacgacgccgccgggccgaggagattacagcatatgttcagtacgggcgatgatatcgtcctgagcgtctggagagagcgcggtgaagaacgcggaatagcccgcgacacgcactaccagatcgcgatactgatcgggatgttttttcgcatccagcagcgtttcgcgggaaacgatgttgtactgaatatgccagcctttatgcacttcaaagaaggtacgcagcaggatcatcagtttctgcttgtcagattcgttctccagcgttgccggattcagtttctggttgagcaacacgccgccgagaatcgctgccgtaggcagtttacccactgagccaatgaccgcagtagggccaagatggtcagtaccggaggccgggcttgcgccttctgccagcggggtgtgggctttacgcccgtccggtgttgccatagtctgcgcgccaaacggtacgttagcggagattgatgacgtacccgcgtaatagttgccgccaaccggaccacgaccgtagcgcggattatggtactgtttcagttcgtcgatataggtctgataagcgcgagccagcagcgtatcgacagtatcatcgtcgttgccgtacttcggcgcaccgttaatcagccgctgacgcagctgctcgtgagtcaggccgtcgaagtcatctgccagtgcggcagcaagctgttgctgaccaatcgcaccttgttcaaacaccagtttcttcactgccgccaggctgttgccgaggttggcaatgccgacctgcaggccagaaacccagtcatatttcgcgccgccttgcttgatacttttcgctcgctcaatacagtcatccaccagcgccgagcagagaatatcgtgcacgttctcttccagcatggtgtcgacgacatattcgatttcgattgatttgcgggtgtagtaacggatttgcgtatcccacgcgtccatcacttcatcgaagttgttgaagttacctgccgacaacgctttttcttgtggcaggaacactttgccgctggtggcatcatgcccgccttccagcgccgccagcatcacgcgggcgaagttgataaagctcatgccggtacagcgatagccccatttgccaccgacggcggtttctatacaaccaatcgctgcgtagtcataagcgtcctgcggttcaataccgagtttaataaattccgggatcacgatttcgtcgttgttgaacgccggcatcccgaagccgcaacggatcacctgtacgcaggcgtcgaggaaatcgttgctcattcctgcatggtaacgcacgctgaggttaggctgagtggaacgcaggcgaccgcaggattcgaggatcgcgtaagagagtggattcaccgcgtccattggttgaccatcaaccagattttgcccgccaatagtgacgttctgatacagcggacttcccgcagaggcttttgagtgtgagccggagcggatcttgttcacttccagcagtttcagccagcagctatgcagcatctcgatggcgtgttcgcgatccagcgtctggttgagttcaacgtcgcggcgatagtacgggtagagatactggtccatacgaccaaacgatactgagtgaccgttagattcgatctgcaaaatcaactggatgaagtaacacagttgcagcgcctgccagaaagtctgcggcggctggtgggcgataagatcgcagttttctgccatcgccagcagttcatcgcgacggctttcgcgggtttcggtcgcggccatttcacgcgccagggcagcgaaacgttcaatgtgttcactgactgccaccagcacgatatcaatcgctttcaggaattgctcaccgtgtaaatcttccagcaccgtcaggttgatgcgcgagcgacgttccgctacttcctcgcgcagaccatcaagccctttttccagcagcagcgggaaattcaccgccaggtgcgcatcgccggaggtcatattgccttccgctttaatgattccggtcgccagcagacctttttgctcatcggtaaacatgccgtagcagcgatcctgtacggtctgaccgcgccaccacgggcacacttcatgcagaacgcgtttgttctcttcgctcaccgcaaagccagcaccgggacgatctgccagatcatcaatctctttttcgatccacgagacagtatattccgggaagatcggcgcggcgcgaacttcgcttgcctggttgccaatgatcaactcatcgtgtttgatccagatggtgcgattcgccaggtgatgcgccagtgccagcgcgcgacgtaccgggatcggcttatcgagatgttgttgatacatctcggtatagtgctgcgcgcgctcggtacagactggcggtttcacaatatgcaccagcgcatttttgtgcgctttaatgcggtcgctgagcgtgtccagtttcagtgtggtcatggttgttatcctcgtaaggtcgcggttaaccctttctggcaggcatactgctgggcaaagtcgagcagttctggcgcatcaagcggtttttccggggcgtcatagggcagattaagtaagtgatatttgttgatgcccagcgtgtggtagggcagaaaatgaatttcgccaacgtgcagctcgtcggcggcaaaatcggtaatggcttttacagaggtttcgtcggcattaaagccctgaatcagcggcacgcggataatgatttttttgcccgctgcggcgagttttttcaggttatccagcactctggcggcgttaccgtcggtccactgtttaaacggcgcgtcggcaacgtgttttaaatcggcaagaaacagatcgatatagggcagagaaggggcgatatatttccacggcacatgcagacaggtttctaccgcagtatgaatgcctgcctcgtggctggcttgcagtagcgccatcgccatttccggctgcataaagggctcaccacccgaaagcgttaaaccgccgccgctgcgatcgtaaaacggtttatcgcgcagaacggtcgtcatgatctcctcaacgcttttcacttcaccacacacggttaatgcctgtgtcggacagcagtcggttaacgccgtcagatgctccggggttaacttttcccgatgaataagcaaaccattcagcgcgcgctcaatcacttccggcgcggccttagcgcacagctcgcagccttccagacacagtcgtgcgtcatacagcagatcctgcgtgcgggcgcggctttccgggttctgacaccagcggcagcccagcgaacagcctttaagaaatacgaccgtgcggataccggggccatcatgggtcgagtagcgctgaatattgaaaatcatagttgcctctctatttcgttcaagcattaaaatactttcgaatgaaagttagattgatgtgcgtcaactgttcagagagttttcccgtgatagtctacattcagacaaaaagtacattttgaggatggttatggaactgtatctggatacttcagacgttgttgcggtgaaggcgctgtcacgtatttttccgctggcgggtgtgaccactaacccaagcattatcgccgcgggtaaaaaaccgctggatgttgtgcttccgcaacttcatgaagcgatgggcggtcaggggcgtctgtttgcccaggtaatggctaccactgccgaagggatggttaatgacgcgcttaagctgcgttctattattgcggatatcgtggtgaaagttccggtgaccgccgaggggctggcagctattaagatgttaaaagcggaagggattccgacgctgggaaccgcggtatatggcgcagcacaagggctgctgtcggcgctggcaggtgcggaatatgttgcgccttacgttaatcgtattgatgctcagggcggtagcggcattcagactgtgaccgacttacaccagttattgaaaatgcatgcgccgcaggcgaaagtgctggcagcgagtttcaaaaccccgcgtcaggcgctggactgcttactggcaggatgtgaatcaattactctgccactggatgtggcacaacagatgattagctatccggcggttgatgccgctgtggcgaagtttgagcaggactggcagggagcgtttggcagaacgtcgatttaaccggacgttctgcatcctcataaattgctgatgacgtggcggagtgccgcgtcttatcaggcctggaggtggcaattactgcccacacacctcacaccccggattacgcatcagtttcatttcgcgaaactgacaggtcatcgcatcgtacatgacgattttcccgctggccggtttgccataacctgccagcattttgatcgcttccattgcctgcaacgaaccaattacgccgatcaacggtgccattacgcctgcttccacgcaggttaatgcattttcaccaaacaaacggctaaggcagcgatagcacggttcaccgtcctgataagtaaagacggtgatttgaccttccatacgaattgccgcgccggaaaccagcggtaccttcgcggcaaaacagcctgcgttcagttgattacgtaccgcaacgttatccgtacagtcgagcaccagatcgtgttcagcaatcaatgctgcaagttctgcgtcatccagcagtgcattgactggcgtaatcgcgatatgtgggttgatccgcgtcagggcgtcacgggcggattccaccttcggttgcccgaccgtggcatcactgtgcagtgtctggcgttgcagattcgagagcgaaaccgtgtcgaagtcgagcagcgtcaggttaccgacaccggcgcttgccagatactgcgaggctgcacagccgaggccgcccaggcccactatcagcacgcgagaatctttcagcgcctcctggccgtcaaaatcaaagccgcgcagaatgatttgccggttgtagcgcagcatctcctgatcgctgagttccgccattacaggcctccgaacaacgcgttaaacggttctacttccacccattcgcccacttccacattgccgcgatcgcgttccagcacgataaagcagttgccgaggctaaaggagctaaatatatgtgaaccctgatgtccggtggtcgtcacttccagttcgccatcggcgttgcgttgcagcacgccgcgctggaaatcaagacgtcctggcgtttttttcaggcgggacgctgtgcgtacgcgctggcgcgcgggcaggccgctggcggtgttaccgcttagttttgccagcaaaggctgtaccagttgatagaaggtcagcgtcgctgaaaccgggttgcccggcaggccgcagaaccagctattgctgagtttaccgaacgcgaacggtttacctggtttaatcgccagcttccagaaggcgatctcccccagctcttcaagaatcgttttggtgtaatccgcctcacccactgaaacaccgccggaactgatcaccacatccgcctggctgtcggcttcaataaatgcggcgcgcagggcatggggatcgtcgcggataatccctaagttaattacctcgcatcccaactgttctaacatcaggtgtacggcgagacggttggtatcgtagatttggccgtcgcccagcggctgaccgggcaactggagttcatcaccggtagaaaaaagcgctacacgcactttacgaatcaccggaacttcggcaatccccagtgaagcaattactggcagctctgcggtagtcaggcgagttcccgccgggaaaacaaccgcacctgcagagatatcttcaccgcgacggcgaatattttgcccgctacgcacttcagcagtaaaacgcacgccattgtccatttgttcagtctgctcctgcatcaccaccgcttcgcagccttccggcaccggcgcaccggtcataatacgaatgcaggtacccgcaggccattcaccatggtatggctgaccggcaaaggatttaccggcaacgggcagcggttgcccggaggcaatatcggctaaacgcaccgcgtagccgtccattgcggagttatcaaaccccggaacatcaagcggcgaaacgacatcgctcgccagaatacgaccaaaacactgtaccagtggcagcgtttcctgggcggtcagtggggtgacgcgagaaagcatctcattaagcgcggtgtcgagcgacatcaatccggtggtaaattccatgaaaacactcctgcggaggcaaaatcgaatttgcctattatgtcagaaaaacgccacagactgtatgccacctcgggcgtagcgctgggtcctgcctttacatgccatatccatctttctatattcaaaaattgaatgagtaattcataaaaattctgatatttatagcaaaagtggcgaaccacccttaatggacgaatactatgggcaaagcagtcattgcaattcatggtggcgcaggtgcaattagccgcgcgcagatgagtctgcaacaggaattacgctacatcgaggcgttgtctgccattgttgaaaccgggcagaaaatgctggaagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccggctggtgatggagcaaagcccgcatgtgatgatgattggcgaaggggcagaaaattttgcgtttgctcgtggcatggagcgcgtctcgccggagattttctccacgtctttgcgttatgaacaactactggcagcgcgcaaggaaggggcaaccgtcctcgaccatagcggtgcgccactggatgaaaaacagaaaatgggcaccgtgggggccgtggcgttggatttagacggcaatttggcggcagccacgtccacaggcggaatgaccaataaattacccggacgagttggcgatagtcccttagtgggtgccggatgctacgccaataacgccagtgtggcggtttcttgtaccggcacgggcgaagtcttcatccgcgcgctggcggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtgatgaacttgatgccggtaatgtgctggcggttgaaaatctgaatattgcctttatgcaggaccagcagaaaatagctgcggtccgcaatctctcttttagtctgcaacgcggtgagacgctggcaattgttggcgaatccggctccggtaagtcagtgactgcgttggcattgatgcgcctgttggaacaggcgggcggtttagtacagtgcgataaaatgctgttgcagcggcgcagtcgcgaagtgattgaacttagcgagcagaacgctgcacaaatgcgccatgttcgcggtgcggatatggcgatgatatttcaggagccgatgacatcgctgaacccggtatttactgtgggtgaacagattgccgaatcaattcgtctgcatcagaacgccagtcgtgaagaagcgatggtcgaggcgaagcggatgctggatcaggtacgcattcctgaggcacaaaccattctttcacgttatccgcatcaactctctggcgggatgcgccagcgagtgatgattgcgatggcgctgtcatgccgcccggcggtgctgattgccgatgagccaaccaccgcgctggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtaccgtcgaacagatttttcatgcaccgcaacatccttacacccgtgcgctgttagctgctgttccgcaacttggtgcgatgaaagggttagattatccccgacgtttcccgttgatatcgcttgaacatccagcgaaacaggccccccccatcgagcagaaaacggtggtggatggcgaacctgttttacgagtgcgtaatcttgtcacccgtttccctttgcgcagcggtttgttgaatcgcgtaacgcgggaagtgcatgccgttgagaaagtcagttttgatctctggcctggcgaaacgctatcgctggtgggcgagtctggcagcggtaaatccactaccgggcgggcgttgctgcgcctggtcgaatcgcagggcggcgaaattatctttaacggtcagcgaatcgataccttgtcacccggcaaacttcaggcattacgccgggatattcagtttatttttcaggacccttacgcttcgctggacccacgtcagaccatcggtgattcgattatcgaaccgctgcgtgtacacggtttattgccaggtaaagacgcggctgcacgcgttgcgtggttgctggagcgcgtgggcctgttacctgaacatgcctggcgttacccgcatgagttttccggcggtcagcgccagcgcatctgcattgctcgcgcgttggcattgaatccaaaagtgatcattgccgacgaagccgtttcggcgctggatgtttctattcgcgggcagattatcaacttgttgctcgatctccagcgtgatttcggcattgcgtatctgtttatctcccacgatatggcggtggtagagcggattagtcatcgtgtggcggtgatgtatctcgggcaaattgttgaaattggtccacggcgcgcggtcttcgaaaacccgcagcatccttatacgcgtaaattactggcggcagttccggtcgctgaaccgtcccgacaacgaccgcagcgtgtactgctgtcggacgatcttcccagcaatattcatctgcgtggcgaagaggtggcagccgtctcgttgcaatgcgtcgggccggggcattacgtcgcacaaccacaatcagaatacgcattcatgcgtagataacattcaggcggagaataaaatggcaagagctgtacaccgtagtgggttagtggcgctgggcattgcgacagcgttgatggcatcttgtgcattcgctgccaaagatgtggtggtggcggtaggatcgaatttcaccacgctcgatccgtatgacgcaaatgacacgttatctcaggccgtagcgaaatcgttttaccaggggctgttcggtctggataaagagatgaaactgaaaaacgtgctggcggagagttataccgtttccgatgacggcattacttacaccgtgaaattgcgggaaggcattaaattccaggatggcaccgatttcaacgccgcggcggtgaaagcgaatctggaccgggccagcgatccggcgaatcatcttaaacgctataacctgtataagaatattgctaaaacggaagcgatcgatccgacaacggtaaagattaccctcaaacagccgttctcagcgtttattaatattcttgcccatccggcgaccgcgatgatttcaccggcagcgctggaaaaatatggcaaggagattggtttttatccggtgggaaccggaccgtatgaactggatacctggaatcagaccgattttgtgaaggtgaaaaaattcgcgggttactggcagccaggattgcccaaactggacagcataacctggcgtccggtggcggataacaacacccgcgcggcaatgctgcaaaccggtgaagcgcagtttgctttccccattccttacgagcaggccacactgctggagaaaaacaaaaatatcgagttgatggccagtccgtcaattatgcagcgttatatcagtatgaacgtgacgcaaaagccgttcgataacccgaaggtccgtgaggcgctgaattacgccattaaccgtccggcgctggtgaaagttgcctttgcgggctatgcaacgccagctactggtgtggtaccgccaagtatcgcctacgcgcaaagttataaaccgtggccttacgatccagtgaaagcgcgcgaattactgaaagaggcgggatatcccaacggtttcagtaccacgctgtggtcgtcacataaccacagcaccgcgcagaaagtgctgcaatttacccagcagcagttagcgcaggtcgggattaaagcccaggtgactgcgatggatgccggacagcgggcggcagaagttgaaggtaaagggcaaaaagagagcggcgtgcggatgttctacactggctggtcggcttcaaccggcgaagcggactgggcactatcgccgctgtttgcctcgcagaactggccaccgacgctgtttaataccgcgttttacagcaataaacaggtggatgacttcctggctcaggcactgaaaactaatgatccggcggaaaagacccgcttatataaggcggcgcaggatatcatctggcaagaatcgccgtggatcccgctggtggtagaaaaactggtgtcggcacacagtaaaaacctgaccggtttttggatcatgccagacaccggcttcagctttgaagacgcggatttgcaataagcaacgcagggagtggaatgcttaattacgttatcaaacgcttactggggttgattccgacgctgtttatcgtctcggtgctggtgtttttatttgtccatatgctgcccggcgatccggcgcgattgattgccgggcccgaagctgatgcgcaggttatagaactggtgcgtcagcagctggggttggatcagccgctgtatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggttatatttggtatggcggcgggaattatcgccgccgtctggcgtaaccgttggccggatcgattgagtatgaccattgcggtgtcggggatctcgtttccggcatttgctctggggatgcttttaattcaggtattctccgttgaactgggctggctgcctaccgtgggagcagacagttggcagcactacattttaccctccctgacgctcggcgcggcagtggccgccgtgatggcgcgctttacccgcgcgtcgtttgtcgatgttttaagcgaagattatatgcgtaccgcgagggcgaaaggggtgagcgaaacctgggttgtcctcaaacacgggctacgtaacgcgatgatcccggtagtgaccatgatgggcttacagtttggctttttgctcggtggttccatcgttgtggagaaagttttcaactggccgggacttggacgcttactcgttgactccgtagaaatgcgtgattacccggtgattcaggcggaaattctgcttttctcgctggaatttattcttatcaacttagtggtggatgtgctttacgccgccattaacccggctatcaggtacaagtaaggatgcgactatttaactggcgacgtcaggcggtgttaaacgccatgccactggtcaaacctgaccaggtacgtacaccgtggcatgaattctggcgacgatttcgccgtcagcatatggcgatgaccgccgcattattcgttattttattgattgtggtggccatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgctcgctggatattatgaaggctggtgggatcggctgatcatgcgcatttgcgatgtgctgtttgccttcccgggtattttactggcgatcgctgttgttgcggtgttgggaagcggcattgctaacgtgattattgcagtcgccattttttccatccccgcgtttgcccgcctggtgcgcggcaacacgctggtgttgaaacagcaaacctttattgagtcagcacgcagtattggtgccagcgatatgaccgttttgttgcgtcatatcctgcctgggaccgtctcttctatcgtggtgtttttcaccatgcgcattggtacctcgattatctctgccgccagcctctcatttctcggcctcggtgcgcagccgccgacaccagagtggggagcaatgctcaatgaggctcgagcggatatggttatcgcgccgcatgtcgctgtttttccggccctggctatttttctgaccgtactggcgttcaatttgttgggcgatggtttacgcgatgcgctggatccgaaaattaaaggatagttacgtttgaatattgcttgaaagggtaatcacctcacaggaaattattgccctaagcaagtgttgtaactttctgctgattttgtagaatcgggtaatttggttaaaaagccgcagcaagggacaatttttgcagcggcacagcgttcagatagttattttgttaaatgtattaacatgctgagtttatacgaaaagataaagataaggctgataattttatttttattggcagcactgtcatttattggtctttttttcatcattaactatcaactggtatcggagcgcgcggtaaaacgtgccgatagccgctttgaacttattcagaaaaacgttggctatttctttaaagatattgaacgttcggccctgacattaaaggactcactgtatttattaaaaaatacagaggagattcaacgcgccgtgattcttaaaatggaaatgatgccatttttagactcggtgggactggtacttgatgataataaatattatcttttttcgcggagggcgaatgataaaatcgttgtttatcatcaggaacaagtaaatggaccgcttgtcgacgagtcagggcgggttatttttgccgattttaacccatcgaaacgaccgtggtcggtggcttcagatgactctaacaacagctggaatccggcatacaattgctttgatcgtccgggtaaaaaatgtatctcttttacgctacacatcaacggcaaagatcacgatttgttagcggtggataaaattcatgtcgatttaaactggcgatatctgaacgagtatcttgatcaaatcagcgctaatgatgaagttctatttttgaaacaaggccatgagatcattgccaagaatcaactcgctcgtgaaaaactgattatttataatagcgaaggtaattataatattattgattctgtcgatactgaatatatcgaaaaaacatcagcggtgccaaacaacgcattattcgaaatctatttttattatcctggcggtaatttattgaacgcatcagataaacttttttatctgccgtttgcgttcattattatcgtattgctggtggtttatttaatgaccactcgtgtgttccgtcggcaattttctgaaatgacagagctggttaatacgctggcgtttttgcctgactcaacggatcaaatcgaggctctgaaaattcgtgaaggcgatgcgaaagagattatcagcatcaaaaattcgatcgcggaaatgaaagatgccgaaattgaacggtcaaataaattgctctcactgatctcttacgatcaggaaagtggttttattaaaaatatggcgattattgagtctaacaataatcagtatctggctgtggggatcatcaaactgtgtggtctggaagccgtggaagcggtgtttggtgttgatgagcgcaataaaatcgtcaggaaattgtgtcagcgaattgccgagaaatatgcgcaatgctgcgatatcgtgacattcaatgccgatctctatttacttctgtgtcgggaaaatgtacagacatttacccgtaaaatagcgatggtaaacgattttgacagcagctttggctaccgcaatctgcgcatccataagtctgccatttgtgaacctttgcagggggaaaacgcctggagttacgcagaaaaactgaaactggcgatttccagtatccgtgaccatatgttctcagagtttattttctgtgatgacgcgaaactcaacgaaatagaagagaatatctggattgcgcgtaatattcgccatgcaatggaaattggcgaactattcctcgtctatcaaccgatcgttgatattaacacccgcgccattctgggcgcggaggcgttgtgccgttgggtgtctgcggagcgggggatcatttcaccgctgaagttcattaccattgctgaagatatcgggtttatcaatgagctgggttatcagattattaaaacggcaatgggtgaattcagacattttagtcagcgtgcgtcgctgaaggatgatttcttactgcatattaatgtttcgccctggcagttaaacgaaccacactttcatgagcgttttaccaccatcatgaaagaaaatggcctgaaggcgaacagcctctgtgttgagatcactgaaaccgtgatcgagcgaattaatgaacatttttatctcaatattgaacaactgcgtaaacaaggggtacggatatcgattgatgactttggcaccggtttgtcaaacctgaaacgtttttatgaaattaatccagacagcataaaggtggactcgcaattcaccggcgatattttcggtactgcgggaaaaattgtgcgcattattttcgacctggcacgctataaccggatcccggtgattgcggaaggcgtagagagcgaagacgttgcgcgcgaattaatcaaattaggatgtgttcaggctcaggggtatctgtaccagaaacccatgccattctccgcctgggataaaagtggaaaattagtaaaagagtagtttacgtatgtccagaatcaataagttcgtacttacagtcagtctgctgatttttatcatgatttcagcagttgcctgcgggatctacactcaaatggtaaaggaacgggtgtatagcctgaaacagtccgttattgatactgcttttgcggtggcaaatattgctgaatatcggcgtagcgtggcaattgatcttatcaacacgctaaatcccacggaggaacagctgttggttggtttgcgcacagcttacgccgactcggtttccccctcttatttgtacgatgtcggtccttatctgatttccagtgacgaatgtattcaggtaaaggagttcgagaaaaattattgtgcagatattatgcaggttgtgaagtatcgacatgtcaaaaatacagggtttatctcttttgacggtaaaaccttcgtctattacctctatccggtaactcacaatcgtagtctgatatttttgcttggtctggagcgtttttctttactgtcaaaatcgctggcgatggacagcgagaacctgatgttctctctatttaagaacggtaaaccggtgaccggtgatgaatataatgctaaaaacgccatcttcaccgtttcggaagcgatggagcacttcgcctatttgccgaccggattgtatgtatttgcgtataaaaaagatgtttatttgcgggtttgtacattgattattttctttgccgcattggtggcagtgatatcgggtgccagttgcctctatctggtacgcagagtgattaatcgtggtattgtggagaaagaagccatcattaataaccattttgaacgcgtactggatggcgggcttttcttttcggctgccgatgtcaaaaaactctacagtatgtataactcggcgttcctggacgacctgaccaaagcaatgggcagaaaatcctttgacgaagatttaaaagcgctgccggaaaaaggcggttatttgtgcctgtttgacgtcgataaattcaaaaacattaacgacaccttcggtcatttgctgggcgatgaagtgttgatgaaagtggtgaaaatccttaaatcacagatcccggtagataaaggtaaagtctaccgcttcggcggtgacgaatttgcggtgatttatacgggtggaacgctggaagagttgctatcgattctaaaagaaatcgttcatttccaggtgggaagcattaatttaagtaccagtatcggtgtagcacattcaaatgaatgtcctaccgtcgaacgcttgaaaatgctggcggatgagcggctgtataagagtaagaaaaacggcagggcacagattagctggcagtaatcattattcgcaggccggacaaatgattttgcccggcctgaattaattaaacccggctaccccacaaatcgtactcatcggcgtgctcgactttcacacgcaggatatcacccggcttaacgttggtttcaccattgagataaaccgcgccgtcgatttccggtgcatctgccatgctgcgaccaatcgcgccttcttcgtccacttcgtcgataatcaccagaatttcacggcccactttctcttgcaggcgctcggcggaaatctgctgctgcagctgcatgaaacggttccagcgttcttctttaacttcttccggaacctggtcaggcagggcattggcgtctgcaccttcaaccgggctgtatttaaagcagccaacgcgatccagacgcgcttctttcaggaagtcgagtagcatctggaaatcttcttctgtctcgccagggaagccgacaataaaggttgagcgtagggtcagttccgggcagatttcgcgccactgtttgatgcgcgccagttggcgatctacagaacccggacgcttcatcagtttgagaatgcgcgggctggcgtgctgcaacggaatgtccagatacggcaggattttgccttctgccatcagtgggatgacgtcgtccacatgcggataagggtaaacgtagtgcagacgtgtccagatccccagtttcgataactgttcgcacaggctgaccatgctggtttttaccggctcgccgttgtggaagccagtacgatgtttaacatcaacgccataggcggaagtatcctgcgagatcaccagaatctctttaacgcccgcatctaccagacgtttcgcttcacttaacacttcgccaatcggacggctcaccaggtcgccgcgcatagacggaataatgcagaaggtgcagcggtgattacagccttcagaaattttcagataggcataatgacgcggcgtcagtttcacaccttgttctggcaccaggctcaggaatgggttgtgtttcggttttggcacgtagtgatgaacgtgctccagaacctgctcatagctatgaggcccggtgatttccagcactttcgggtggacttcgcggatctgatcttcttttgcccccagacaaccggtcacaataaccttgccgttttcattcaacgcttcaccaatggcttccagtgattcttgtaccgcgctgtcaataaagccgcaggtgttgacgatcaccatgtccgcatcgtcatagctcggtaccacgtcataaccttcagtgcggagttcggtgagaatacgctctgaatcaacaaggtttttcggacagccaagggaaacaaagccgattttcggctggggagttactttgctcatagcttaaaaaatattcagttacaggaaaggtcagggcagggattctacagagttctggataaaatttgtatcgcaatctcattcgctggcggaggcgaaggaaatgtaaattttgttaattcggcgtgaagaattgatcctggacagcattttgctcaaaaaatagccatactatttaattgcaacaaggctgggaagaggaggatcgaagtatgttcgttgacagacagcgaatcgatctgctgaaccggttgatcgacgcacgcgttgacctcgccgcatacgtgcaactgaggaaggcaaaaggatacatgtccgtcagcgaaagcaatcatctacgagataacttttttaaactgaatcgcgaactgcacgataaatcgctgcggttgaatcttcatctggatcaggaagagtggagtgctcttcatcatgctgaagaagcattagcgacagccgcagtatgtttgatgagtgggcaccatgattgcccgactgttattaccgtcaacgccgataagcttgaaaattgtctgatgagcttaacgctgagtatccagagcctgcagaagcacgccatgcttgagaaggcctgaaaactaagggggagaaagcgtctcccccttcatgtttaagtttttgtaaaaatgaatttgttatctcctccactgactacgctttaagccagagtcaatccggaggcgttatgcatcgacaatcctttttccttgtgccccttatttgtctttcttccgctctctgggcggctcctgcaacggtaaatgtcgaagtactgcaagacaaactcgaccatccctgggcactggcctttttacccgataatcacggtatgttaatcactctgcgcggcggcgagttgcgtcactggcaagcaggaaaaggattatctgcgccgctttccggagttccggacgtttgggcgcacgggcagggcggcctgctggacgtggttttagcgcctgattttgctcagtctcgccgcatctggttaagttattccgaagttggcgatgatggcaaagccggaactgctgtgggttatggccgcttaagtgatgatctctcaaaagtgaccgacttccgcaccgtctttcgccagatgccaaaactgtctaccggcaaccattttggcgggcggctggtattcgacggtaaaggttatctttttattgctctgggcgaaaacaatcagcgcccgacggcgcaggatctggataaattacagggcaaactggtgcgtctgaccgaccagggcgaaatcccggatgataatccttttataaaggaatccggtgcgcgcgccgagatctggtcttatggcattcgtaatccgcaaggaatggcgatgaatccgtggagtaatgcactgtggctgaatgaacatggcccgcgcggtggtgatgaaattaatatcccgcaaaaaggcaaaaactacggctggccgctggcaacctggggaatcaactattcaggctttaagataccggaagcgaaaggggagatcgtcgccgggaccgagcaacctgttttttactggaaagattcgcccgctgtgagcggcatggccttctataacagcgataaattcccccagtggcagcaaaaattatttattggcgcgctgaaagataaagatgtcattgtgatgagcgtcaacggcgacaaagtgacagaagatggccgtattttaacggacagagggcagcgaattcgtgatgttcgcactggacccgacggttatttatacgttctcaccgacgagtccagtggggaattacttaaagttagcccacgcaattagctaacgggaatcatcaccactttgcgcactgcggggcgttcagtgagttgctgataccagcgttgcagatttggacgcggtgtccaggtcaggccaacgttaaacaaattgtagatgaacggtgcgatagcgatatcgcccacaccaaactcgtcgccagagaaccattttacttttgccagttccgcatcgagcagggcaaacagggcgtcgcactctttgcaactggcatcaatggcggcctgatcgcgctcttccggtggtgttctgactaatcccatcaggatcccgcgatgagcattactgagcgtctggtttgcccagtccatccatttttccgcttccgcacgacgtgccggtgagtcgatccacaggcgtttttgcccgtactgtgccgccagatagcggacaatggcgtttgattcccaaagaatgagatcactttcgtcgtcacgcaacaacggcaccagcccgttagggttcatcgccagaaaatcagcatcgtgatttatcccaaactcacggcccgcgagaatttgctcataaggtagttccagttcttcgagcgtcagcaatactttttttacgttagttgaattattccgaccccacagcgtaatcatactcaccccttttccgacaggcagccacaggctgaacaggactccgatggtgaagtaaagttaacttttaagcaacagctggcaaaaaaatgacaccagaagcagcgaagcggcaggatattgcataaactttaaaaactttaccaacttacggtttctttaagtttgtgtgtgcgttattaatcaccaaacttatcatacggcgatataacgtattttttttgaatggatactcgggtggcatttatgacgcaatactcctctctccttcgtggtcttgcagcgggttctgcatttttattcctttttgccccaacggcattcgcggcggaacaaaccgttgaagcgccgagcgtggatgcgcgtgcatggattttaatggattacgccagcggtaaagtgctggcagaaggcaatgcggatgagaaactggatcccgcgagcctgactaaaatcatgaccagctatgtggttgggcaggcgcttaaggccgataagattaaactcaccgatatggtgacggtcggtaaagatgcctgggcgacgggaaatccggcactgcgtggttcatcggtaatgttcctcaaaccgggcgatcaggtttcggtggcagacttgaacaaaggtgtgattatccagtccggtaatgacgcctgtattgcgctggctgattacgttgccgggagccaggagtcatttattggtctgatgaatggttatgccaaaaaactgggtctgaccaacactaccttccagacggtgcacggcctggatgcgccggggcagttcagcaccgcgcgcgatatggcattgctgggtaaagcattgatccacgatgtgccggaagagtacgccattcataaagagaaagagttcaccttcaacaaaattcgtcagcctaaccgtaaccgtctgctgtggagcagcaatctgaatgttgatggcatgaagacaggaaccacggcaggcgcgggatataatctggttgcttcggctacccagggcgatatgcgtttaatctccgtagtgttgggggcgaaaaccgaccgtatccgttttaatgagtctgagaaattattgacctggggtttccgcttctttgaaaccgtgacgccaattaaacctgatgccacctttgtgactcagcgcgtctggtttggtgataagagcgaagtgaatctcggggcaggtgaagcgggctcagtgaccataccgcgtgggcagctgaaaaacctgaaagcgagttatacgttaacggaaccgcagcttaccgcaccgctgaaaaaaggtcaggttgtcgggaccattgatttccagcttaacggtaaatccattgagcagcgtccgctgatcgtgatggaaaatgtggaagagggcggattctttggtcgggtgtgggatttcgtgatgatgaaattccatcagtggttcggcagctggttctcttaatcttctgataaccggatggcgcgaaacgtcatccggttatacgtcattaatacatcaacttaatgcgctgcgtctgcgcgtacttcacatactcatcttccgggcaacaatcgctcaccacaatatcaaagcgtttcaggtcacccatgcgcgccggacgcaccttgccaaatttactgtggtcgacaaccagcacatgcttttgcgccatcgacatggcccagtgttttaccggcaactcttcaagattaaaacaggtagcgcctttactgacatgcacgcccgccgcagaataaaaagcgatatccgggcaaaaattattcagcgtttgctgaaaatcgatgggtttgaaaatggcgttgctggcgtgaaattcaccaccgcaaagaaacgcgcggcaatggggtttctctttcagcgccagaaaggtatttagcgaataacaaacggcggtaaaagggatttcattatcaatcgcttcaataatccacggcgtggtggtgccacagtcaaaaaagagggtctgatcgggttctaccagcgtcgcagccagttttgccgcccggcgtttttcttccaccaggcgggatttttgatcgcttaacaggtaatggctggcactgcgcggttccagaacaatatagccgccgagcaaaacgacgggcgcactgtggttgttcagatcgcgacgaatcgtcatctccgaaaccccaagcagggcggcggcgtctttaagatgtaacttatcgctgcgttttaattcttgcagcagctgcccgatacgctcttcgcgacgtgtttccataatccctctgaatagttattgaagcgagccgctcaatactacactttttagcagagatcagtcacgcacccagcctttgcggatcggtaatgcaaaacagacgcgataccacgattgcagacgttgatagagtttatgccccatcgcttgccagataatctgggcactaaggcagccaatcatacctgccagcaatccaccgagcatatccagcggccagtggacgccaagataaacgcgcgaccaggcaatgacgacggccagcaccattaaaagtgagccggaccacaggcgatgccagcataaaaatgccagtgcaaaggtgaaaatcaccgtaccgtgatcgcttgggaatgagtcatccgccgcatgatgcaggaagttatagccgatattttcgacaaagggtcggtcgtgcggaaaaagatgtcccatcgtccaggacacaaacaggctgaccgccagcgcgatagcgatttttatcaccagttgccgttgtgctgtaagcccccacaaccaaagtaccacggccagcaacggcaccacggtaatcaaatctttagcaataaaaatcgccaacgagatcatccacggagccgagtctggcgtcgcgttaataagagagaatagagagagattcaaattttccagcataacttcccgacgcaaagtgattaaaagggagccaatacaggcaagtcgttgagaataaagtgcaggttaaactgggtaaagcggcatcgtcttatttccctcaagcggcctgtttacggtgggtgattgtaacgggcataggttaaataaaacttaaagaaagcgtagctatactcgtaataatgtaagaatgtgcttaaccgtggtttcagctacaaaattcgctttctcgttagctgcgcttttattaaactctgcgcgattattattggcgaagaaattgcatgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgaccgcgtatctggcgggcgggatgtttttacaatggctgctggggccgctgtcggatcgtattggtcgccgtccggtgatgctggcgggagtggtgtggtttatcgtcacctgtctggcaatattgctggcgcaaaacattgaacaattcaccctgttgcgcttcttgcagggcataagcctctgtttcattggcgctgtgggatacgccgcaattcaggaatccttcgaagaggcggtttgtatcaagatcaccgcgctgatggcgaacgtggcgctgattgctccgctacttggtccgctggtgggcgcggcgtggatccatgtgctgccctgggaggggatgtttgttttgtttgccgcattggcagcgatctcctttttcggtctgcaacgagccatgcctgaaaccgccacgcgtataggcgagaaactgtcactgaaagaactcggtcgtgactataagctggtgctgaagaacggccgctttgtggcgggggcgctggcgctgggattcgttagtctgccgttgctggcgtggatcgcccagtcgccgattatcatcattaccggcgagcagttgagcagctatgaatatggcttgctgcaagtgcctattttcggggcgttaattgcgggtaacttgctgttagcgcgtctgacctcgcgccgcaccgtacgttcgctgattattatgggcggctggccgattatgattggtctattggtcgctgctgcggcaacggttatctcatcgcacgcgtatttatggatgactgccgggttaagtatttatgctttcggtattggtctggcgaatgcgggactggtgcgattaaccctgtttgccagcgatatgagtaaaggtacggtttctgccgcgatgggaatgctgcaaatgctgatctttaccgttggtattgaaatcagcaaacatgcctggctgaacgggggcaacggactgtttaatctcttcaaccttgtcaacggaattttgtggctgtcgctgatggttatctttttaaaagataaacagatgggaaattctcacgaagggtaaaaaaatgcctgactgctttgtgcgatcaggcattctcgaattaatggtgatggtcgtcaatctggtgttcgataaccatcccttcacctacgctggcaagatggcgaacataaggatgcgggcggtaagccggagctggcgcaggagccacatagacggtttgcggcacagtcgcgacgctgaccgcttgtggaacgctgactgaatcaggaaccacaaccactttgtatccactcggcacatcgacggtgacactttgcgccatcgccacaccagtaaagcccattaaaagcgcgcccaacagtagacaatttttcataatcatttcgcctgaaataatgcagcgggttaatttccgcgaattatgcagccttcattcaggcattgtgttgccgggcgtgctgccggttttattggtcaaatggcgcttcgtgtttaagaactttatcgatcacatccagtacgccttcacggttattggagcctgcgcggtattttgccgctgcgacgaccgcgctaccggcattttccattgcaaaactaaagcctgcctgacgcagcatctcaatatcgttaccgccatcgccaaagaccaccacttcgctgtcgtctattccccataatttctgcagttggcgaaggccattggctttatgtacgccggggataatcagatcgatgctgccgttgccggtgtggaccgacaccataatatcgccgatggcctcatgtaatgctttttgtacttgtggaatcagttcatcggaaagattcaggccaaacttaaagaagatatcctctaagttgtcaaagttatcgacgtattccagacggtgataatacatttccgccaccgttttcatggcatcgtcatattttttgagtgtataggcactattttttccgcaggcaataatttccacttccgggcgcgtcagcaaatgttccacgacagtagcaaacgcatccttcgatagctcgccattaaaaacatctttgccttcgctcactacccagccgccgttttcagccacaaaggcaatttcattagcaatttcagggaagaaagagatcaactgataatattgattcccgctggcgactacaaagcgaattccttgtgctttcatttgctgatactgagccataaaccgctcacggttataggttttttgatcgcttaagaaagtaccatccatgtctaccgcaattaatttaatgctcatcaactattctccatcgccgtctgcgttttggtatcgggtttggcgacggctttcgcgacaatagccgcgagaataaccagcgccagtacaaccagcattgcactacgtaatccataatgttcgccgagatagcccagcagcggcggcccgacgaggaaagccagataaccggtcgttgctaccacactgacgcgggttggtgcatcggggccggtatcgctggcggcagaaatggtcagcgggaagcccagcgaggcacccagtccccagagtacaacagacaccccagcgacccaggcgctatcgacaaaaataatcagcccaatacccaacgcccccattagtgcactggcccgaaccacggcaacgcgactgtaacggtcgatgaaccaaccgccggtgaagcgtccaacggtcatccccagggtaaaaccggcataaatcagcgagccggaagtagggctaaaaccgtgaccgtcaaccattaataagggtaaccagtcgttggcagaaccttcggcaaaggccatcgccagcaccacaacacctatcagcagcaactggatatcgcgataaaaaggtacgcctttttcgccatgctgggtgccatcggcagcatttttgcccgtaccgtcagggattgcctgaatggcgatataaataggtgcgatacctaccagcgccgccaataaaatgtgcaccgttgccggaacgccaaaggccgtcagtgccatcccgacacctgcgcctgccagcgtgcccaggctataaaaaccgtgcatcatcggcaaaaccgtcttattcatttctcgctcaacggcagcaccttcaacgtttatcgccacttccgcagaaccaaaacttgccccaaagacgccgagaccaacggcaaagagcaggggcgatgtcagccagagtgccagacttaatatcatcatcccgatcaatgcgcaggacatcgtgaccaggatgacattacgtgtcccaaagcgtttcactaaccacgccgagcagagaataccgctcatcgaaccgatcgacagaccaaagagaacaccgcccatttcagcgatcgagacagagagaatatcgcggatagcaggcgtacgggttgcccaggacgccattaacaggcctggcaaaaagaagaacataaacagcgcccaggttcggcgtttcaatgcattacgtgaagaatttacggtcatagatcacgtcaaaataagaagagggaagacaacattagcaaggttgtgtacatttgtacacaattgcagagagaggaaatgacatgcgtcgcgctaacgatccgcaacggcgagaaaaaattatccaggccacgctggaggcggtgaaactttacggaatacatgctgttacgcaccgcaaaattgctacccttgccggggtaccgttgggatcgatgacctactatttttcaggaattgatgagttgttactggaggcgttcagcagttttactgagatcatgtcccggcaatatcaggcattttttagcgatgttagtgatgctccgggcgcatgccaggctatcaccgatatgatctacagctcacaggttgcaacgccggataacatggagctgatgtaccagctctacgcgctggctagccgaaaaccgctattaaaaacggtaatgcaaaactggatgcagcgcagtcagcaaacgctcgaacaatggtttgaacccggaaccgcccgcgcgcttgatgcgtttattgaggggatgacgctgcattttgtcaccgaccgtaagccgctatcgcgcgaggagattttgaggatggttgagagggttgcagggtagtagataagttttagataacaaaaaacccatcaaccttgaaccgaaatggcggggttgatgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtacgtgcgcccatcattgcgccgaacaacagcgcgcggttcattcgcaatacataagcaccgaacaagaaacagataaccacgggcaccagactgacaatcaatccggcaatcaacatctgaccgccaatcgcgcccaggccgttattaataccgctaccggcgctcagaccaacgcctgccataaacaccatcaagccgaactctttcaccatgcttaatgcaccctgcggaatgtaaccgaaggtcgggtggttagcacgcataaagcccagcataattccggcgaataacaacccggcagcgttccccatgccgaaactgaatgtgctgaactggaaggtgatcatcccgatcatcagcccaataacaaagaaggcgcagaatgccagcaggtcagtgacctggctgtgaatcgagataaagccgatgcgatcggcgatggtttttacgcggcgggcatcgccgctgacttgtaaaacgtcacctttgttaagcacgacgttgtcatctatcggcatctcaatctggctacgaatgacgcggttaaggaagcaaccgtgatcggtcaacttcagttgtgcgagacgtttacctacagcgttatggtttttaacgaccacttcttcagtgacgatacgcatgtcgagaaggtcacgatcgaaaacttctttaccgttacggaagctgggatcgagtcgggcatgggcgtcgggatagcctaccaacgctatttcatcgcccatttgtagcacggcatcaccgtctggatttgccagaatcccgttacgtcgaatacgttcaatgtagcagccggtttgtcgataaatacccagttcacgcagatttttgccgtcggtccaggccaccagttccgggccgacgcgataggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagcctgctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcgaccccgacgcagaaaataaacagcataaagccaagattaagcgcatcggtgttaatgctgaaatgttgttggcctaataacagcgatacgactaaaacgccaatggaattacccagttggatcgaaccaagtcgtaactttccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaacgatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgcctttttctggcgacgcacatgaaaggcgcttttcgggctgccgggcatcctgaaatcggcttgctatttttcattcttcctggagcagtcgccagcttcttttcacagcgtagagaagtcctgaaacctctgtttggcgcaatgctggcggcaccctgttcgatgctcattatgcggctgtttttttcaccgacgcgctcattctggcaagagctggcatggttactaagcgcggtgttctggtgtgcgctgggggcactgtgtttcttatttatcagtagtttgtttaaaccacagcacagaaaaaatcagtaaagccctcaacgcgagggcttgtcagacgatcaggcgtccagattttctttcacccatgcagcaaaatcggtatagccgccgatatgttgctgatcgacaaaaatctgcggcacggtttctacgggtttacctgccttttgttgtagatcttctttagtgatcccttccgcacgaatatctacatactgatactgaaaatcatcgcgttcattgctcaatttctcagccagatcttttgcacgcacacagtaagggcaacccgaacgaccaaaaataacggtttgcattatttctctcctcatagatttatgcctgtaatgatcacgctaaaatgtattcgctgaaagtaggtttaacctgttgcattaattgctaaaagctataactgttaaacacaatacagtgaaaagttttagactgaaggctcactttgcagagggaagcgtatgcgcgcgatcggtaaattgcctaaaggcgtgttgatactggaatttatcggaatgatgctactggcggtggcgctgctgtcggtaagcgactccctgtcgctgcctgagccattttctcggccagaagtgcagattctgatgatttttctcggtgttttgctcatgcttcccgctgcggtggtggttattcttcaggtggcaaaacgtcttgccccacagctgatgaaccgtccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaatcgcagcggaatcgctgggattgggcggggtatatatcggcggcctgcgcaataatattgaagcggtgacgaaactgcttaaattaccgcagcatgttctgccgctgtttgggctgtgccttggctggcctgcggataatccggatcttaagccgcgtttaccggcctccattttggtgcatgaaaacagctatcaaccgctggataaaggcgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaaaaccgccacgtcgatgtatgatacgcgggcttttgaccaggtctgacagagaggtgcagggtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagttggttgaaggcacgcagggaattggcgtcgtgctggcggagacgcgtcaggcggcggaaagcgtgattgacgctttccgcggtctgaacgcgcatattctggtgcaggaatatatcaaagaggcgcaagggtgcgatatccgctgtctggttgttggcgatgaagtggtcgctgcgattgaacggcgggcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaggtgaatgcgtcgccggggctggaaggaatagaaaaaaccaccggtatcgacatcgcgggtaaaatgatccgctggatcgaacgccacgctacgacagaatattgcctgaaaacgggtggttagtcgcaatcacattactgatcatggttttgcctgcgctttttgcgtaagctgtgccggtctttttatcgaaagaggttgtacaaaattatgacatcgctggtcgttcctggtctggatacgctgcgtcaatggctcgatgacctggggatgagtttttttgaatgtgataactgtcaggctctgcatctgccccatatgcagaatttcgacggtgtctttgatgccaaaatcgatctgatcgataacacgatcctgttttctgccatggcggaagtccgaccttcagccgtattgccgctggcggcggatttatctgccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgatgatgaagggcaaaacaacgttaccgaaaactatttcctccactgataactcctttcgagcacgcagtcgctggtgcagtggctgcgcgctgcaaaattatctgctgtttttaaccttttcttaaagattatttcacttctcttgtgtcgatttggctttatcacatagagcaaatatgcataaaaatttgttaaataccgttttttaatccgagctatagtctcaaaccctggctaaagttattcttgcgatgcttttatatagcgagcagtgctggccgggagaaagttctcttttcttacaccgcgccgataaaaaatatgcacgtttattgcatatctttcagtgtgacaacttttgttcgtttgttaacgaactttcagaaggaaagagatatgaccgccttaaataaaaaatggctatcgggtctggttgcgggtgctctgatggccgtctctgtcggcacgctcgcggctgaacaaaaaacactccacatttataactggtctgattatatcgccccggacacggtggccaattttgaaaaagaaaccggtattaaagtcgtctacgatgttttcgactctaacgaagtactggaaggcaaattaatggccgggagtaccggctttgatctggtggttccatctgccagctttctggagcgccagttgactgcgggagttttccagccgctggacaaaagcaaattgccggagtggaagaatctcgacccggaactgctgaagctggtcgccaaacacgatcccgacaataaatttgctatgccctatatgtgggcgacgaccgggattggctataacgttgataaagttaaagcggtgctgggcgaaaacgcgcccgtcgatagctgggacttgatcctcaaacctgaaaatctggaaaaactgaaaagctgcggtgtctctttcctggatgcgccagaagaagtttttgctaccgtgttgaattatctcggcaaagatcccaacagcactaaagcggatgattacaccggaccggcaacagatctgctgttaaagctgcgcccgaacattcgttatttccattcatctcaatacattaacgacctggcaaacggcgatatttgcgtcgctatcggctgggcaggtgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgcccggatgtagtagcgcatatttccgaccatgtgttctatgccaacgccaataaagcagccacgccgctggtgagtgcggaagtccgtgagaacccaggtatttatccgcctgcggatgttcgtgcgaagctgttcactctgaaagtgcaggatccgaaaatcgaccgtgtgcgcacccgcgcgtggaccaaagtgaagagcggaaaataatccgcagtcgtagatgccggaggggcgcaccacacccgccggcaattcgcaccattatggtgcgcttgcacacattcaatgccggagagcagccgtgaatgacgctatccctcgcccgcaggcgaaaacccgtaaggcgctgacgccgctattagaaatccgcaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggtttcgaacaaccttctgccggacagataatgcttgatggcgtcgatttgtcacaggttccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgctcggcctggtgcatatgcaggagttcgccaaacgcaaaccgcatcagctttccggtggtcagcgacaacgtgtggccctggcccgaagccttgcgaagcgcccgaaactattactgctcgatgagccgatgggcgcgctggataaaaagctgcgtgacaggatgcagcttgaagtggtggatattctggagcgcgtcggtgtgacttgtgtgatggtcacccacgatcaggaagaggcgatgaccatggcggggcgcatcgccattatgaatcgtgggaaatttgtccagattggcgaaccggaagagatctacgagcatccgactacccgctatagcgccgaatttattggctcggtaaacgtctttgaaggcgtactcaaagagcgtcaggaagatggcctggtgcttgattcgccggggctggtgcatccactgaaagtcgacgcggatgcctcggtggtcgataacgtgccggtacatgtggcgctgcgcccggaaaaaatcatgctttgcgaagagccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaaggagcaaagatgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgattgtctttaaaataagcctggcggagatggcgcgcgctattccaccttataccgaactgatggagtgggctgacgggcaactgtccatcactcttaatctcggtaattttctgcaactgaccgacgatccgctctatttcgatgcttatctccagtcgctacaggtggctgcgatttcgacattttgctgtttactgatcggctatccgctggcgtgggcggtggcgcacagtaagccttcgacccgtaatattttattactactggtgatcctgccgtcgtggacctcgtttctgatccgcgtttatgcctggatgggaatattaaaaaacaacggtgtgctgaataattttctgctgtggctgggggttatcgatcaaccgctgaccattctgcataccaatctggccgtttatatcggcattgtttacgcttacgtgccgtttatggtactgccgatttataccgcgttgattcgtattgattattcgctggtggaagcagcgctggatctcggtgcacgaccgctgaaaacgttctttactgtgatcgtgccgctgactaaaggtgggattattgccggatcgatgctggtgtttatcccggctgtgggcgagtttgtgatcccggaactgctcggtggcccggacagcatcatgatcgggcgcgtgctatggcaagagtttttcaataaccgcgactggccggtggcctcggcggtagcgatcatcatgttgctgctgctaattgtgccgataatgtggttccacaaacaccagcaaaaaagcgtgggagaacacggatgaataatttaccggtagttcgttcgccctggcggattgtgattttgctgctgggctttacctttctctacgcgccaatgctgatgctggttatctattcgtttaacagctcgaagctggtgacggtgtgggccggctggtcaacgcgctggtatggtgagttattgcgcgatgacgcgatgatgagtgcggttggtttaagtctgacaattgcggcctgtgcggcgacggcggcggcgatcctcggaactattgcggcggtggtgctggtgcgctttggcaggtttcgcggatcaaatggctttgcctttatgatcaccgcgccgctggtaatgccagatgtcatcacgggcttgtcgctgttgttattattcgtcgcgcttgctcatgccattggctggcctgcggaccgcggtatgctcaccatctggctggcgcatgtcactttttgtacggcttatgtggcggtcgttatttcttcaagattgcgggaactggatcgctcgatagaagaagcagcgatggatctcggtgcgacgccgctgaaagtgtttttcgtcattacgctaccgatgatcatgcccgcgatcatttctggctggttactggcttttactttgtcgcttgatgatctggtgatcgccagctttgtttccgggccgggagccaccacgttaccgatgctggtcttttccagcgtgcggatgggggtgaatccggaaatcaacgccctggcaacattgatcctcggcgcggtcggaattgtcggatttatcgcctggtatctgatggctcgcgcagaaaaacagcggatacgcgacatccagcgtgcaagacgtggctgaagacactaaaatttgccaacctggctacataatgccgcgcatgtcgcggcattgttttcatggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttaagcagtctggtgctggttttcattgagatctggtgtgcgttttcactggtgaaagggcgtcgctgggcgcgctggctatatctgctgacacaaatcaccgccgcaagttacttgtgggcggcttcgctggggtacggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataatgcagccgattccagagcaactctccgctaaaaccgccgatcttaaaaatctgctcgccgactttccggttgaggaatggtgcgcgccggtgtcaggcccggaacaagggtttcgtaataaagccaaaatggtggtgagtggtagcgttgaaaaaccactgctcggtatgctgcatcgcgatggcacaccagaagacctttgtgactgcccgctttatcctgcctcatttgcgcccgtttttgcggcgctaaaaccgtttatcgcccgagcggggttaacgccctacaacgtggcgcgtaagcgtggcgaactgaaatacattctgctgactgaaagccagagtgatggaggcatgatgctgcgctttgtactgcgttctgataccaagctggcgcaactgcgtaaggcgctgccgtggttacacgaacaactaccgcagctgaaagttattaccgtcaatattcagccggtacatatggcgattatggaaggggagacggagatctacctgaccgaacaacaggcactggcggagcgttttaatgacgtaccgctgtggatccgtccgcaaagtttcttccagactaatccggcggtcgccagccagttgtacgccaccgcgcgcgactgggtacgacagctgccggttaaacatatgtgggatctgttctgcggtgtggggggctttggtttacactgcgcgacgcctgacatgcagttaaccgggatcgaaattgcatcagaggccattgcctgtgcaaagcagtcagccgctgaactgggcttaacgcgtttgcaatttcaggcgctggactccactcagtttgccaccgctcagggggatgtgccggagctggtgctggttaacccgccgcgccgcggcattggtaaaccgctgtgtgattatctctcaacgatggcaccgcgttttatcatctactccagctgtaacgcccaaactatggcgaaagatatccgcgaactgcctgggtttcgtattgaacgggtgcagcttttcgatatgttcccgcataccgcgcactatgaagtgctgacgctgctggtgaagcaataaaaaagccgcatgtgcggcttcagattgctgacaaagtgcgcgttgtttatgccggatgcggcgtaaacgccttatccggcctacaaaagcgtgcaaattcaatacattgcatgggccatgtaggcctgataagcgtagcgcatcaggcaattttacctttgtcatcagtctcaagccgcggttgcggctttctgaatcttactgtgggaaccactggtcactgattttttgataagtaccgtcagctttaattgctgccagcgcgttattcagtttttccagcagggctttgttatccggacgtacagcgatgcccaggccggtgccaaaatattgcggatcggtcactttctcagtagcaacaccaagttgtggattggttttcagccattcgtttaccaccgctgtgtcaccaaataccccatcaatacgaccatttttcagatcgataaaggcattctgataactgtcataagagacagttttcacttccgggtgctgatcctgaatatatttctggtgcgtagtaccgttttccatcccaatacgtttgcctttcagatcggcaaacgttttgtaggtatcttttttggcaatcacgacggctgagttttcatagtagggcgtggtaaacgatacctgtttgctacgctccggggtgatatccataccggagattacggcgtcatattttctgaatttcagggacgggatcaggctgtcgaacgcgtgattagtaaaagtacattctgcctgcatttgtttgcacaaggcttttgccagatcgatatcaaagccgacaatctcattattagcacctatagattcaaagggtggataggtggctgaaacgccaaaattgattttctctgcggcagaagcaccgaaagtaaaggaagcaagtaaagcggcaagaactaactttttcatgatggaactcccgtctgtcaatcttatgatttttggccgtgtctgcggcatgggataacaatgccatcaagtgaatttatatgcaataaacatgattaaataatttaaatgaaataaaaaagacggacaacttagtgggttgtccgtcttcattataagaatttatgcactatgtaggccggataaggcgtccccgccgcatccggcacaggcaccgtgctgatgtctgatgcgacgctggcgcgtcttatcagacctacaaaaccccccggcgaatgtacgcagccacattaatttcgccgttcgaatgccagcgctttgcgctcgatcagacgcatcatcagcgtcagcaggccgttaacgaccaggtaaataatccctgccgcaccgaacaccattacatcgtaggtgcgtccgtacaacaactggctgtatcccatcacttccatcagcgtaatggtgtatgccagagaggtacttttgaataccagcaccacttcgttggaataagaagagagcgagcgtttaaaggcatacggcagcaggatcgccagcgtatcttttttgctcattcccagggcgctacaggactgccactgaccttccgggatcgcacgaattgcaccgtaaaacagctgcgtggtatacgccgcactattcagcgacaacgcaatcagcgcacataaccacggttctgacaacaaatgccacagtgccggatactcctgcaaagtcggaaactggcccggcccgtaataaatcaggaagatctgcaccagcagcggcgtaccggtaaacagcgtgatataaccccgcaccagccacaccagcaccggcgttttcagcgtcaggatgatggtaaaaatcaatgccagaatcagtgccacaatcagcgaggcaacggttagcgtcaggctggtgtgtagccctttcatcagttcgggtaaatactcaaacattagctgggcctccgctcaaaacgtgtcgcgcgcaggtcaatgcgtttgagaatgtactgactgagcagggtgatcaccaggtaaatcgccgccgccacaatgtaccaggtaaatggttcctgggtacgagtagcgatgctttttgtttgcagcattaaatcattcacactaatcaaactgaccagcgcggtatctttcagcagcaccagccactggttaccgaggccaggcagcgcatgacgccacatctgcggcatcaccagacggaaaaagatagccgatttcgacagccccagcgcctgaccagactcccactgacccaccggcaccgctttcaacgcgccccgaagcgtttgcgaggcataggcggcatacagcagtgacagagcgatgacaccacaaaggaacgggctaacgtcgaagttctcaatgtccatctgcactgggatctgcacgaacccaagattgatagtgaagccatccgaaagcgtcagcagcagctgcgaggagccaaaatagataaacagcaccaccagaatttctggcaggccacgcagaatggttaccagcgctgaacctgcccacgcgacaggacgccattttgccgactcccataccgcaaagaacatcgccagcgccagcccgacaatcaatgcacaaacggcaaggccgacggtcatcccggcggcgcttgctaaaggaaaaaattcattcatcaggaattacttctggaaccatttgttgtagatggtttcgtaagtgccatctttcttcactttttccagcgcagtgttgagtttctgctgcagctcagtgttgccctgacgtaccgcgatgccgaggccagtgccgaagtaatctttatcggtcactttgtcgcccaccgccgccagtttcgggttatctttcagccactcagtgaccactgcggtgtcaccgaagacgccgtcgatacgcccgttttgcagatccagttttgcgttctggtagctgtcatacggaacggtagtgatttccgggtgcttatccataatgaatttctggtgtgtcgtcccgttctgtacgccgacttttttgcctttcagctgatcaacactggtgtatttgccttgctgacccacaaacagggcagagttgtcatagtacggggtggtaaacagcacctgcttttcacgctccggagtgatatccatgcccgccatcacggcttctacgcgacggaatttcaggcttgggatcaggctgtcaaacgcctggttagagaaagtgcaggttgcatcaatctctttacacagcgcttgtgccaggtcgacgtcaaaaccaacgatctggttgtttgcatcaatcgattcaaacggaggataggaggcttcggtagcaaaacgaatggtttcggcagctgtggcggaaagactaaaacctgcaattaacgcggcaatcagaacttttttcattgttgttatcccgaatcttagtgagagagatagtttttaaatgcttcggtttgcggctcggtaaagcagctcgcgtcgccttgttctacgatatgaccattttccatatacaccactcggctggcggttttacgcgccacttcaacttcgtgggtgacgatcacctgggtaatattcgtttctgccagctcacgaatgatgctgacgatttgtgccgtaatttccgggtccagtgcggcggtcggttcatcgaacagcagtacctgcggttccatcatcaacgcacgggcaatagcaacacgctgctgctgaccaccagaaagatgcagcgggtaacgatcgctataaggtttgagacgcagacgttccagcagtttttctgcacgggccagcgcctgatctttactcaaccccagtacacggcagggcgcttcaatcaggttttgctgcacggtcagatgcggccacaggttgtattgctgaaacaccatgccaacgttacgacgcaaatcgcgaatcgctttgtcagagggtgttttggtgaaatcgaaatggttgcctgcaatgttgagcgtaccggagcgcggcatctcaagcagattgagtacacgcagcagcgagcttttacccgcgccgctggggccaagtaacaccagcgtttcgccctgtgggcaatccagcgtgatatcgaacagcgcctgatgcgcgccgtagaagcaattaatgccgtttaattgaatactcattgacactcgtatactggcagtctgatagctattgaggtcgaagatagtacctttgacagaataattatgcaatatttctgctttaaaagttaaaagcaaagcgcattattcaataaacatagcacaaaataacgggggcggtggtcggcgagcataaatgtcggcattcctcacgaaatgccggacaatttacggggtttattggttgatcaaggcgttagcgattctcgatggactgacggagcgtacccgccgtggcatgaacgctaccgcctaagtaacgcacatcgtcgatgacccaacactggccttcctgaatcattaacacttcatcctgccaaccctggtcaccctgtttgagatccacgcgcaatggaatgttacgggcatcacgattagggatagtcgatgcactggcaacgtgggcgctatctggcaaggtggttcgactggagaatggatcgttggtcagtagttcccgatggttattatcccgggaggcatcgctaagcagtgtcgccagtttgtcgctcagataagggcgcaaggcggtgatgtcgttgctgcggtgcaaaatgcggtagtcataaaattgctgggccacgttatccgggcctccttcaacgcaaggaccactgcgtgtgccgttatctttataagctggagtgactgtggtgcaggcactgaggagcagtgcgcaggggataagcattgtcaatttgctgtagcgcataatgatttccttataagcgatcgctctgaaagcgttctacgataataatgatatcctttcaataatagcgtatcagtctgataatgcttttgagatcgaaggcttagcaaacaaggagatcgatcatgcaattttctacaaccccaactctggaaggccagaccatcgttgaatattgcggtgtggtgaccggcgaagcgattttaggtgccaatattttccgtgatttctttgccggtatccgcgatatcgttggcggacgttccggtgcgtatgaaaaagaactgcgtaaagcacgggagatcgcctttgaggaattaggctcccaggcgcgggcgctgggggccgatgccgtcgtcggtattgatatcgactacgaaacggtcgggcaaaacggcagtatgctgatggttagcgtcagcggtacggcggtgaaaacgcgtcgatgagaagattcttctggctggtcgctgccgctctgttattggcagggtgtgcaggcgaaaaaggcattgtcgagaaagagggatatcagcttgatacccgacgccaggcgcaggcggcgtatccgcgcattaaagtgctggtgatccactacaccgcagatgattttgatagctcgctggcgacactgaccgataagcaggtcagctcgcattatctggtccctgcggtaccaccgcgatacaacggtaaaccgcgcatctggcaactggtgccggaacaagaactggcctggcatgcggggattagcgcctggcgcggggcaacgcgccttaacgacacctctattggcattgagctggaaaaccgtggctggcaaaaatcggccggagtgaaatattttgccccgtttgaaccggcacagattcaggcgcttattccactggcgaaagatattattgcccgttatcacatcaagccggaaaacgtagtggcacatgcggatatcgcaccgcagcgcaaagacgatccggggccattatttccctggcagcaactggcgcagcaggggattggtgcctggccggatgcgcagcgggttaacttttaccttgccgggcgcgcgccgcacacaccggtagataccgcgtcattgctggagcttttggcgcgctacggttatgacgttaaacctgatatgacaccgcgcgagcagcggcgcgtgattatggcattccagatgcatttccgcccgacgttatataacggcgaagcggatgcagaaactcaggcgattgccgaagcattgctggagaaatacgggcaggattagcgcggcagttttccgtggtcgcgtagccaggcggcagttttctcgataccttcatccagggtgatgaccggctgataacctaactcttcctgcgcacgcgtaatatccagcgtaaagtcaaaattcaacttggagacgccgtagtgggtcagcggcggctcttttgctgacttgcggcctaaacgctccatgctgcgggcgatcatatccagcatcgggtaggggacggaacgaatacgacagtcaatattcaactcgtcgatcagcttctgcacgatgctgcgcagtgtgcgatgctcgccgttggtgatgttgtacacacgcccggaaggtagcttatcgcaggcttcctggcttgccagccacattgcgtgcacggcattttcatagtaggtcatatcgaccagcgcactgccgccatgcggtaacagaatactgccgtagtggtgcatcatatgcgccagacggggaataaagactttatcgtgcggtccgaacagactttgtgggcgcagaatagtaaagcgcgtttgtggattcgcctgcgaaagcatattgatcacttcttcgctggctgctttgctgcgggcaaactcgttggcgaagcggtgagggcgaaaatcttctttaatatcgcgatggtggtgataatcgaagtacagggagggggaagagatatgaataaagttacgcacaccccaggcgacagcccattcacccaggcggcgagtggcgcgaacgttagccagatcgaaagcctgttgtgtcccccagggtgaggtaaagctggagcagtgccacagcgtatcaatgcccgcgagcatcactttagcttgtgatgaaaccagctcggtcagatccgccggaacaaactctgcgcccattttttccagcaatttgcccattgcctcgttgcgaccggtcgctcgcacgctgatgcctttctggcataaaaactctaccgcgtttcgacctaagccgctggtggcgccggtaaccagtaccttcatatcaatccactgttgttgagaaaataacgtgcgcattcttccgtgatttcccccatgatgcaatgggaaacatgaaagaataacgcaggttttgtcgattaatctgtgctttgttctgccagtctggcgatttgttttgccattccgcgaaaaataaacagatgcgcggggatcatcaataaccagtaaaacagccccggcataccgtgcggatgccagaaagcgcggacatcgatagtacgatagtcgcctttatcttccaggctaaaacacagtcgtcccagccccggcgctttcatgccaaataacaacgtaagttgtttttccggttcaacgacaatcactttccagctatccaccgcatcgccagtctgtaaatattcgcgctccgggcggcctttcgccagcttatgaccgatcgcgcggtccatcaacgcccgtgtctgccacaaaatattgccaaagaaataacgctctttaccgccgatttggttcactacctgccataaagcagcaaggctggcggacgttttaacggtaaaccccgcctgtttggcaaaataaccgtactccggtcgccagcgggcaaaggcctgagcgtcgtagccccagtcgctggagttgaccagtttttcctcctctttcaacgtgctacgtaccgcgtcatcgaaagcgatcagccgttgtgggatgagtgcacgtagcgcggtatcatccgccagcagatcgtgtttcagcccctgaatcaacgccctggcggtggtgggcggtacggaagtaatcacattgagaaaccacaccgaaatccagcgggtggggagggggatggggatcaaccagcggcgcttaccgctcaccgccataaaatgttcaaactgttgctgataactgagcacctctggtccggcggcttcgaagatgcggtgttcgctggccggatgatctaacaacgcaaccagatagtgcagcaagttttccagcgcaatgggcgtggtgcgtgaacgaacccagcgcggaggcgttaagactggcaggttgtagaccatatcgcgcatgacttcgaacgccgcggaacctgcgccaacgataattccggcccgcagttcggtcacgggtacattcgcttcacgcagaatgtccgccgtagcctgacgagcacgcagatgatccgactgctcatgtggcggggcctgcaacgaactaagaaagattaattgcttaactggtacttcacgtagcgcatcgcggacgttgagagccacctggcgctcctgagcgataaaatcgccgccttcgcccatgctgtgcaccagaaaatagaccgtatcgatatcctgcaacagggccggtaggttatccggccagctgagatcgactttatggcaactgacgtttgccagttgcagctttgcaagcctgtcgacatgacgtgccgccgccaggatctgatgcccttgctggctgagtgtgcgcaccagatgctgaccaatgtagccactggcaccgagaactaaaatgcgttgcggcacgtctctctccttaacgcgccaggaatgcacgccagtgggcggcgacttccgccagttgttcgcgcgagacgtcaagatgcgtcaccaggcggacaatcggcgaggcgttaatcagcacgtttctcgctttcatgtattcgcctaacgcggcagcattttcttccccgacgcgaacaaacagcatattggtgtcctgacgcatcacatccgcgcctgcttcacgcagctgctccgccatccaggcagcgttgtcgtggtcttcctgcaagcgcgcaacgttatttttcagggcatatatcccggcggcagccagaatgccggactggcgcatcccgccacctgtcattttccgccagcgaatggcacgtttaatgtaatcacgattaccgacgagtaatgaaccgactggcgtcccaagacctttcgacaggcaaatggtgaacgaatcacaatattgcgtgatctctttcagttcgcagccgtaagccaccacggcattaaagatgcgcgcaccgtcaacatgcagcgccagattgcgctcgcgggtaaattcccatgcttctttcaggtattcccgcggcaacactttgccgttgtgggtgttttccagactgagtaatttggtgcgggcgaaatggatatcgtcgggtttgattttcatcgccactttatccagcggtagcgtgccgtcggcagccgcgtctatgggttgcggttgaatactgcccagcaccgccgcgccaccggcttcaaacagatagttatgcgcggcctgaccgacaatatactcttcgccgcgttcgcagtgactgagcagagcgaccaggttggcctgagtgccggtaggcagaaaaatggcggcttctttaccggaaagctctgctgcgtagtcctgcagagcattaacggtagggtcgtctccgtaaacgtcgtccccaaccggggcggccatcatcgcttcgagcatggcgcggcttggtcgggtaacggtatcactgcgtaaatcaatcatggcatgtccttattatgacgggaaatgccaccctttttaccttagccagtttgttttcgccagttcgatcacttcatcaccgcgtccgctgatgattgcgcgcagcatatacaggctgaaacctttggcctgttcgagtttgatctgcggtggaatggctaactcttctttggcgaccaccacatccaccaacaccggaccgtcgatggagaaggcgcgttgcagggcttcatcaacttcagacgctttttctacacggatacccgtaatgccgcacgcttcggcaatgcgggcaaagtttgtgtcgtgtagttcggtgccgtcagtcaaatagccaccagctttcatctccatcgccacaaagcccagcacgctgttgttaaagacgacaattttcactggcagtttcatctgcactactgagaggaaatcgcccatcaacatgctaaaaccgccatcgccgcacatggcgaccacctgacgttctggctctgtcgcctgcgcacccagcgcctgcggcatggcgttagccatcgaaccgtggttaaacgaacctaacaggcgacgcttgccgttcatttttagataacgtgccgcccacaccgttggcgtaccaacgtcacaggtgaaaatagcgtcatcggcggcaaaatgactaatttgctgcgccagatattgcgggtgaatggctttctcgctcggtttagctaaatcgtccagccctttgcgggcgtcgcggtaatcttccagcgctttatccagaaacttgcgatcggctttttcttccaccaatggaagcaatgcacgcagagtcgacttgatatcgccgaccagtgccatatccaccttgctgtgagcgccgatgctggctgggttgatatcaatctgaatgattttggcatcggtcgggtagaaggcgcggtagggaaattgcgtgccgagtagcactaacgtgtcggcgttcatcatggtatggaaacctgacgagaagccgattaacccggtcattccaacatcatacggattatcgtattcgacatgttctttaccgcgcagggcatgaacaataggcgctttaattttcccggcaaactcaactaactctttatgcgcccccgcgcagccgctgccacacatcagggcgatattgctggaataacgcagcagttgcgccagtttgcgtaactcttcttcttccggcgtcacgactggttgtggcgcatgataccagtgcatggttgccccttctggcgcaggttttaacgccacgtcgcctggtaacacgacaaccgaaacgccacggttaagcaccgctttgcgcatggcaatcgccagtacttgtgggatctgctccgggctggaaaccagctcgcaatagtgactacattcgcggaatagctcttgtgggtgggtttcctggaaatagccgctgccaatttcgctggagggaatatgagcggcaatcgccagtaccggaacgtgattgcggtggcaatcgaacaggccgttgattaagtgcaggttgccggggccgcacgatccggcgcagaccgccagttctccgctaagttgtgcttcagcgccagcggcaaaggccgccacttcttcgtggcgggtggacatccactcgatggtgcccatgcgattaagactgtcactaagaccgttcagagagtcgcctgtgactccccagatgcgtttcacccctgccgattcgagtgttttggcgatataagctgcaaccgtttgtttcatggttctccatctcctgaatgtgataacggtaacaagtttagttcatctgacggagggggaagggatgggagagaaaggaggcactaacggttaaatagcccgatgaaaggaatatcatcgggcataaggcgattatgcgagaaccaaatccccctgcggatggcaggagcaggccagtacgtaaccttcagcgatttcggcgtcggtcagcgtcattgtgctgctcaccgtatattcaccggaaaccacttttgtcttacagcagccgcaaacacccgcacggcaggcagcgacaaccggaacgttattgctttccagcgcctccagtagcgtggtgccaaccggggcgtaaaattctcgtgccggttgcagtttggtgaatttcagaccgctggtcgccgcttctgctactggggtgaagaatttctctttaaagaaacgcgtcacgccgagcgctttcacttcctgctctacccaatccatatacggagccgggccgcaggtcatcacggtacgtgaagctaagtcaggtacacctgccagcagttcgcgagtgagacgaccagcgataaagccttcggtaacgttattttctgccaccagcgttaccggatagttacgccactcatcggcgaaaataacatcctgcggcgtacgcacgttgtagatcacccgcacatcggcctgtggacggttcttcgcaagccagcgacgcatcgacataatcggcgtgacgccgcagcctgccgccagcaacaggaatttatcttctgctttatcgtcgcaggtaaattcccccatcgcgtccgaaagccagagataatcaccgcgttttacatcgcgcgtcagccactgggagccgacaccgtcatcaatccgccgcacggtcagggtgatatattcactcacgcctggcgtggaggaaatggtgtaagcacgcagcgtttccgctgagtttcgcacgctgaccagtgcatattgcccggcgcgatatgggtagtaatcgtggcaaatcagggaaatcgtccacacatccggcgtttcttgcgtaatgtgatgaacctgcatccgccacgggcattgattcgttggcatcgtcatcgacaaactccttacgcgctcaacagttgcttcatgtcttcttcaacagtggtgatagaacgcaggccgaatttctcgttcagcaccgccagcaggtctggtgtcaggaaaccaggtgcagtcgggccggtgacgatatttttcacgcccagagaaagcagcgtcagcagaatgacgatcgctttctgttcaaaccaggagagcaccagcgacagcggcagatcgttgacaccgcagcccagtttctctgccagagtgacagccagaataatcgctgagtaagcatcgttacattgacctgcatctaccagacgcggcagaccttcgatatcgccaaactcaagtttgttaaagcgatatttaccacaggcgagggtcaggatcaggcagtcatccggcacgctggtggcgaaatcggtgaagtagtggcgctcgccgcgtgcgccgtcacagccaccaagcaggaagatatgacgcagtttttcacggctcaccagatcaatcagcgtatcagcagcgccaagcagcgtctggcgaccaaaacccacggtgataaggtgcggaatttcgctgtacgggaagcctgccatctgttgcgcctgggtgataaccgcagagaaatcatcaccgtccagatgacgcacgccaggccagccaacaatgctgcgggtccagatacgatcgtcataagcgcctacggttgggtcgatgatgcagttcgaggtcatcacgatggggccagggaaacgagcgaactccacttgctgattctgccagccgctgccgtagttaccgaccagatgcttgaatttacgcagctccgggtagccatgcgcaggcagcatttcgccgtgggtgtagacattaacgcccgtgccttcggtctgttccagcaggttgtagagatctttgagatcgtgaccggaaatcagaatgcatttacccgccgtcgctttgacgttgacctgggttggcgtcgggtgaccgtatttaccggtttcgcctgcatccagaatgctcatcactttgaagttcatctggccgatttccattgaacactcaagaagcgcgttcatatcggcaggccaggtccccagccacgccatgattttatggtactgggcataaatatcgttgtcgtattgaccgagaacatgcgcgtgttccatataggccgccgcacctttcaggccatacaggcacagcagacgcaggccgagaatgttttcgccaatcgccgctttatctttgttaggggtaaattctgctgcctgacgttgcagctcgccgagatcgtcgctcaccagttgcaggtcagccatcgggttatcgacgcgcgcgttggcatctacagccaggcattgcgctttcagcgcctcgcgcagggcaatcgcttcacgagcgtagccgacaatacgcggagaatcgaagttaacgttggtcagggttgagaaaaaggcacgtggcgcgaagctgtcaacatcgtggttgatgatgccgtattcacgcgcttttaccgcccaggcagaaagcccttgcagcgccgcgatgagtaaatcctgaaggtcagaagtttccgccgttttaccacacatcccctgcgcgtatgagcagccgtttcctgccggagtacggatagtttgttcacattgcacacaaaacatgatcacaccttttaaagttatatttaatatacatgtttaaggttaagacgcttaacgcggggataaaagggatttttcatgcaactttaagggagattgatttagcgcaattttggcggcagggatctaccgccagagaggtattacgcagagaaaaaggcgatgaggatcggcactaacaggctaagaataaaaccgtgaacaattgccgccgggaccatatccagcccgccagtacgttgaagaacgggcagggtgaaatccattgatgtggcaccgcataagcccagtgcagtagagcggctgcggcgaatcagcccagggatcaacataatagcaatcagttcacgggccagatcattaaaaaacgccgcgctcccgattaccggaccaaaagattcggtcaataaaataccggaaagagaataccagccgaaaccggaggccattgccagcgcggtattgatggggagatcaagaataaaggcgttaattaaaccaccaattaatgaactgacaaccaccaccacggcgacaatcattccccggcgattaaggacaatctgctttaaggtcatgccattattgcgcaactgaataccaacgaggaaaagtagcaaaattaacgtgtattcactggcttcggtcgcgtgttgtaagaaagccagtccacttagaccaatggcaaaaccaatcactactacgccgcacagttttagcgactccagcgccatcgcaatacgcgacgggagtttttcttgctgatggtggttgcgccacggcaggcctcgctccagccacatcagggcggcaatattacacagtaaaataacggtaatactgacggcagaataatgcagaatcgccaacaggttactggcgaggttatcgagaaacgccagactgatacccataaaaaagagaataaggtaaaccatccagcttaatagctgattaataacttttaacgcagcttgttggcgaagcggaatgaggtaacccacaatcaggggaaccagaatgattaacagcccagaaaacatgaaaacccagtccttgcaaagatgaagtcgaaatgcgcgatgacacactactgaaagcggaaggacgagtaaagttgcaattaaaaggaaatgttatgcataaggagcagtagagtattcgttttcatttaaagatattcttgcgctttaattacaaactgcaccgatgttggtggcgtcaaaatcgccgaggcgttccctgaaggccggggcagcccacatggatgtgggctgagggcgcgttttacagggatgttacctcgcgcccgacccggtagccgtaagggataagtcgagggcaccgcgcagcggcgattttgttcgccagagcccgggggtgcagggggcggcggcgattggccgccccctgcgcgctccttgcgccagtggcaatatgttgcttagctcatgaaaggagcgcaacaagatgatgaatcaacatataacaacatcttaaaaaaaggcctgacattacgccaggccttctgcgttaattaatcacgcttttccagcagggtccggtaaatcagaccaccgataatgccgccgacaattggcaccacccagaagaaccacagttgttctaatgcccagccgccctggaagatagcaaccgcggtgctgcgcgccgggttaacagaagtgttagtcaccggaatactaattaagtgaatcagggttaaggccagaccaatagcgatcggcgcaaaacctgccggcgcgaatttgtcggttgcgccgtggatcaccaacaggaaacctgcactcaataccagttcaactaccagcgcggaaagcatggaataaccgcctggtgaatgctcgccataaccgttagaagcaaaaccgctggctgccgcgtcaaaacccgttttaccactggcaattaaatacagcagcgccgctgcaacaataccgccgacaacctgggcaattacgtagccaacgacttcttttgccggaaaacgtccgccagcccataaaccaatagtgaccgccgggttaaaatgaccaccagaaatatgaccaacagcaaaggccatcgtcagaacggtcagaccgaacgccaacgccacgccggcaaaaccaatgcctaattccgggaagcctgcggccagtacagcactaccacagccaccaaaaacaagccagaaagtaccaaaacattcagctgctaattttctgaacatatccaccacaattaaaaattgaccctgtgaaaaatatggtcgttttatagggtcgtcgtaaaaaagtgacgacggaaataatgcgcggctattttaaaaacgaaggcgagtcattcaccagataaataaatccagtaaatttgatttagggcaacagcgggttgccccatatagtcatttgtctgattgacagtgtagtgcacgcaaaagatttaatcctttaggcgtaataaaaaataatttatcatgctaattatttgattttgttgtttttgcagacttatcagcaagagggagtataacgcgattattcgctcatttttcagacatttgccatgcttaaatgtgatgtcatcacgtattagcaaggcctttcccgttatactgccagcgtaaaggataagtcacatatttctggaggggatatgattcttgagcgcgttgaaattgtgggttttcgcggtatcaaccgtttgtcgttgatgctggaacaaaacaacgtcctgattggggagaacgcgtggggtaaatccagcttgctggacgccttaactctgctgctatcgccagaatcagatctctaccattttgagcgcgacgatttctggttcccgccgggagatatcaacgggcgagaacatcatctgcatattattttgaccttccgcgaatcgctgccaggccgacatcgggttcgccgttatcggccgctggaagcgtgctggacgccatgcaccgatggctatcaccgtattttttatcgtctggaaggggagagtgcggaagacggcagcgtgatgacactgcgcagttttctcgataaagacggacatccgattgatgtcgaggatattaacgatcaggcacgccatctggtgcgtttaatgccggtgctgcgcttgcgtgatgcccgttttatgcgccgtattcgtaacggcacggtgccaaatgtccctaatgtggaagtcaccgcgcgccagctcgatttcctcgcccgtgagttatcctcacatccgcaaaatctctctgatgggcagattcgtcagggactttccgcaatggtacagctgcttgagcattatttctctgagcagggggccggacaggcgcgatatcgtttaatgcggcggcgagccagcaatgagcaacgaagctggcgctatctggatatcatcaaccggatgattgaccgacctggtgggcgctcgtatcgggttattttgctcggcctatttgctactttgttgcaggcaaaaggcacattgcgactggataaagacgcccgtccattgttgctgatcgaagatccagaaacccgtttacaccccattatgctttcagttgcctggcatctgttgaatcttctgccattgcagcgcattgccaccaccaactcgggtgagttgctttcgttaacgccggtagagcatgtttgccgactggtacgtgagtcctcgcgcgttgccgcctggcgtctggggccgagtggcttgagtaccgaagatagccgacgcatatcctttcacattcgttttaaccgtccgtcatcgctgtttgcacgctgctggttgctggtggaaggggaaacggaaacctgggttatcaatgaactggcgcgtcagtgcggacatcattttgatgccgaagggatcaaggtcattgagtttgcccagtccgggctaaagccactggttaaatttgcccgccgaatggggattgaatggcatgtactggtcgatggcgatgaagcagggaagaaatatgccgctacggtacgcagcctgttgaataacgatcgggaagccgaacgagaacatttaacggcgttaccggcgctggatatggaacattttatgtatcgccagggattttccgatgtgttccaccgcatggcgcaaatcccggaaaatgtaccgatgaatctacgcaaaattatctcgaaagcgatccatcgctcttccaaacccgatcttgccattgaagtggcaatggaggcaggacgtcgtggtgtggactccgtaccgacgctgctgaaaaaaatgttctcacgcgtgctgtggctggcgcgcggtcgcgcggattaaccgcgaaacatcgtggccatttgtggctgaatagcgtcgagcatctcatagcgccgacggtattcagcccgttttttactggcgatttcggcaatctcttttcgtgctatctgtgctggaaggcggtaatggcgttcagcatcacatacgccgccaaccgattcccagaaagcgttgtaatcagcgtggatcttgccttctttatcgcgataacgcaggctgcggtaaatatgcgtttcattgctgacggcaataatctgctctacctgcaaacgttgggcaaacagacaggccgcttccatcacgaggcgtttgggaaatagcccgtggcaggctttcgtcgcattctggatttcctgatgtggaatttcccattttgcgccttgcagtccgccaataaacatcgttcttttcccctgatattcacacagggtaaacgtgatctctgccagaggaataccttcgctgttgcggaacaggattgtgctgtcaccttctttatccattgagatcatcatggtcagctcaagcgtgaactgctcgccgtttttgccttccagcttcgccagttgcagcccgggggtattcaaatataagctgaattcttccgccgacatacattcgcggagtaacgcataatggtaacgtaacgcctccagcaattgcttacggctaagattcgccgcaaggtaagggcgatgcagacgcacaggcagtcgcggctggcgcgttaacaatacattgagattaggccagtgggaaagttcgttcatccactcaacgcttaaacgcggcataatcaacgagcgcagcaaaaatttctggcgaaaactacggcgatgccagaatttacccggccgacactgtccacgtgccagactaagaaaaagtgacaggctgctgagagattcagatggcgtaaaggtccgttcagttagctgcgacatattcatgaaatcaatggttatacatggcgtcgatttcaccattgcgtatcttaaccaaacatcaatagtgtgattactaacgtaaattttagggttttgttgatatttcgttgaagttaatgacccggattggcatatggagtattcagaaaatttatgaaaaagcggaaaaccgtgaagaagcgttacgttattgcgctggtgatagtcatcgccggactgattacgttatggagaattcttaacgcacccgtgccgacttatcagacgctgattgtgcgccccggtgatttacagcaaagcgtgctggcgaccggaaagctggacgcgctgcgtaaggttgatgtgggcgcgcaggtcagcggtcagttgaaaactctgtcggtggcgattggcgataaagtaaaaaaagaccagcttttaggggttattgatcctgaacaggctgaaaaccagattaaggaggtcgaagcaacgctgatggagctacgtgcgcagcggcagcaggcggaagcggagctgaaactggcgcgggtgacgtattcccgtcagcaacgtctggcacaaacgaaggctgtttcacagcaggatctcgacaccgccgcgacggagatggctgtgaaacaggcgcaaattggcaccattgacgcgcaaatcaagcgcaatcaggcttctctcgatacggctaaaaccaatctcgattacactcgcatcgttgccccgatggccggggaagtcacgcaaatcaccactctgcaaggccagacggtgattgccgcacaacaagcaccgaacattctgacgctggcagatatgagcgccatgctggtaaaagcgcaggtttctgaagcggatgtaatccacctgaagccggggcaaaaagcctggtttacggtgcttggcgatccactgacgcgctacgaggggcaaatcaaggatgtactaccgacgccggaaaaggttaacgacgctattttctattacgcccgttttgaagtccccaaccccaatggtttgctgcggctggatatgactgcgcaagtgcatattcagctcaccgatgtgaaaaatgtgctgacgatccctctgtcggcgttaggcgatccggttggcgataatcgttataaagtcaaattgttgcgtaatggtgaaacacgcgagcgtgaagtgacgattggcgcacgtaacgataccgatgttgagattgtcaaagggcttgaagcgggcgatgaagtggtgattggtgaggccaaaccaggagctgcacaatgacgcctttgctcgaattaaaggatattcgtcgcagctatcctgccggtgatgagcaggttgaggtgctgaagggcatcagcctcgatatttatgcgggtgagatggtcgcgattgttggcgcttcgggttccggtaaatcgaccctgatgaatattctcggctgtctggataaggccaccagcggcacctatcgcgtcgccggtcaggatgttgccacgctggacgccgatgcgctggcgcaactgcgccgcgagcatttcggctttattttccagcgttaccatttgctttcgcatttaaccgccgagcagaacgttgaagtacccgccgtctatgctggtcttgagcggaaacagcgactgcttcgtgcccaggagttgctgcaacggctggggctggaagaccgtacagagtattatccggcacagctttcgggtggtcagcaacagcgcgtcagcatcgcgcgggcattgatgaacggtggtcaggtaattcttgccgatgaaccaaccggcgcactggacagccattctggcgaagaggtgatggcgatcctgcatcagctgcgcgatcgtgggcatacggtgattatcgtcacccacgatccgcaggtcgctgctcaggccgagcgggtgatcgaaattcgcgacggcgaaattgtgcgcaatcctcccgccattgaaaaagtgaatgttactggcgggacggaacctgttgtcaacacggtgtctggctggcggcagtttgtcagcggttttaacgaggcgctgacgatggcatggcgggcgctggcagcgaataaaatgcgtactttactgaccatgctggggattattatcggtattgcgtcggtggtttccattgtcgtggtgggtgacgccgccaaacaaatggtgctggcggatattcgttctattggtacgaatactattgatgtctatcccgggaaagattttggcgatgacgatccgcaatatcagcaggcgctgaagtacgacgacttaatcgccatccaaaaacaaccgtgggtcgcctcagccacacctgccgtctcgcaaaacctgcgcctgcgttataacaatgttgatgttgctgccagtgccaatggcgtgagcggcgattattttaatgtctatggcatgaccttcagtgaaggaaacacctttaatcaggagcagctgaacggtcgtgcgcaggtcgtggttctcgacagtaatactcgccgccagcttttcccccataaagcagatgtggttggcgaggtgattctggtcggcaatatgcccgccagagtcattggtgtggcggaagaaaaacagtcgatgtttggtagcagtaaagtgctgcgtgtctggctaccttacagcacgatgtccgggcgagttatgggccagtcgtggcttaactccattactgtcagggtgaaagaaggatttgacagcgccgaggcggaacagcaactcacgcgtttactttcactgcgccacggaaagaaggatttctttacctggaacatggacggcgtcttgaaaactgttgaaaagaccacacgtactttacaactgtttctgacgctggtggcggtgatttcgctggtggtgggcggtattggtgtaatgaatattatgctggtgtcagtgaccgagcggacgcgggaaattggcattcgcatggctgtaggtgcgcgagcaagcgatgttttgcaacagttcctgatcgaagccgtactggtttgcctggtcggtggcgcgttgggaataacactgtcactgttaattgctttcaccttgcagcttttcttacccggctgggagattggtttttcaccgttggcgctgctgctggcgtttctctgctcgacggtcaccgggattttatttggctggttacccgcacgaaatgcggcacgactggatccagtagatgctctggcacgagagtaatttttgagataaaaatgccagccgatcgggctggcattttgcctttaggatgtacacaatgagacagaagagctatgcgactgccgcttctacttcgacgggcacaataacactggcgtgattgccttttggcccctggtggacatcaaactgaacggattgtccagcttttagcgttctgtaaccatccatctgaatggtggaataatgagcgaaaatatcttcgccgccgccttcagggcagatgaaaccaaaccctttggcattgttgaaccacttaacagtacccttttccatgcttcgacatccttcgcaaatcttatacaagtaagatggaataaaccggggtcagagagggggctgttcaaaacctcgccaactctagaaatacaatttagagaattagggcgagccgtcaagcatttgacaggggacaaggggcaggtatgaatcaaaaatttgaagcagttaacgctattgacaggaatgtgacagatgtcgctgatgccaacgatagatgatagttatctatcatgtggagtagattggtcaggcaaataagctcttgtcagcggcagggcgttctgccgataaccgtaaccgaagatgataactgacaatgggtaaaacgaacgactggctggactttgatcaactggcggaagaaaaagttcgcgacgcgctaaaaccgccatctatgtataaagtgatattagtcaatgatgattacactccgatggagtttgttattgacgtgttacaaaaattcttttcttatgatgtagaacgtgcaacgcaattgatgctcgctgttcactaccaggggaaggccatttgcggagtctttaccgccgaggttgcagaaaccaaagtggcgatggtgaacaagtacgcgagggagaatgagcatccattgctgtgtacgctagaaaaagcctgaatgcaggcataaaaattgggggaggtgcctatgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgtaaacatgaagtcagccgtctcgatgtggtgaactttatctctcatggcacgcgtaaagacgagccgacacagtcttctgatcctggcagccagccaaacagcgaagaacaagctggtggggaggaacgtatggagaatttcacgacgaacctgaatcagcttgcgcgcgtgggcggaatcgacccactgattggtcgtgagaaggagctggagcgtgctattcaggttctctgccgtcgccgtaaaaacaacccgctgctggtgggggaatctggtgtcggtaaaaccgcgattgcggaaggtcttgcctggcgaattgttcagggcgatgtgccggaagtgatggctgactgtacgatttactctctcgatatcggttctctgttagcgggcacaaaatatcgcggcgactttgaaaaacgttttaaagcgttgctcaagcagctggagcaggacactaacagcatcctgtttattgatgagatccacaccattatcggtgcgggtgcagcgtctggtggtcaggtcgatgcggctaacctaatcaaaccgttgctctccagcggtaaaattcgtgtaattggttcgacaacctatcaggagttcagcaacattttcgagaaagaccgtgctctggcgcgtcgcttccagaaaattgatattactgaaccgtcgatcgaagaaactgttcaaatcatcaatggcctgaaaccgaagtatgaagcgcaccacgacgtgcgttataccgcaaaagcggtgcgtgcggcggtagagctggcggtgaaatacattaacgatcgtcatctgccggataaagccattgatgttatcgacgaagcgggcgctcgcgcacgcctgatgccggtaagcaaacgcaagaaaaccgttaatgtggcggatattgagtccgtggtggcccgtattgcacgcattccagagaagagtgtttctcagagtgatcgtgataccctgaaaaacctcggcgatcgcttgaaaatgctggtcttcggtcaggataaagccattgaggcgctgactgaagccattaagatggcgcgtgcaggtttaggtcacgaacataaaccggttggttcgttcctgtttgccggccctaccggggtcgggaaaacagaggtgacggtacagctttcgaaagctttgggcattgagcttctgcgctttgatatgtccgagtatatggaacgccataccgtcagccgtcttattggtgcgcctccgggatacgttggttttgatcagggcggtttgctgactgatgcggtcatcaagcatccacatgcggtgctgctgctggacgaaatcgagaaagcgcacccggacgtgttcaatattctgttgcaggtgatggataacggtacgctgaccgataacaacggacgcaaagcagacttccgtaacgtggtgctggtgatgaccaccaacgccggggtacgggaaactgagcgcaaatccattggtcttatccaccaggataacagcaccgatgcgatggaagagatcaagaagatctttacaccggaattccgtaaccgtctcgacaacattatctggtttgatcatctgtcaaccgacgtgatccatcaggtggtggataaattcatcgtcgagttgcaggttcagctggatcagaaaggtgtttctctggaagtgagccaggaagcgcgtaactggctggccgagaaaggttacgaccgggcaatgggcgctcgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaatctgattgttaggtaggttggtcaagtccgtaatctcgaaagaggttacggactttttgtttatggggtggaggaggttcagaccctttttttaatgatgatggtaagttgttgataattagtgctgcgggaaggtaaggataaaaaagggtgctgcaggagaatgggatggttttgctttattaacaacgggctaaacgtgtagtatttgagttcactgccgtacaggcagcttagaaattcacaggtaacatactccacccgcccaccatgttcactgccgtacagacagataaaatgcgaaaaaaaagctcgcactttcgtacgagctcttctttaaatatggcggtgagggggggattcgaacccccgatacgttgccgtatacacactttccaggcgtgctccttcagccactcggacacctcaccaaattgttttgctaccaaacctcatgggtggcaacggggcgctactatagggagttggagtaaaacggtcaagaagaattttaatgataattattgtttgctcatactgtaaacaagttgtgcagtatatctacatcgagacaagttacggacttatacttccaaagtacttcatacatatcacaaaataaaaaggccggttaaaccgaccttttactcgttctttctcttcgcccatcaggcggtaaaacaatcagcgactacggaagacaatgcggcctttgctcaggtcgtacggggtcagttcaacagtcactttgtcgcccgtcaggatgcggatgtagtttttgcgcattttaccggagatgtgtgcagtaaccacgtgaccgttttctaactctacgcggaacatggtattaggcaacgtttcaagaacggtaccttgcatttcaatattgtcttctttggccatctaatcctctggggtatcactaccgtaatttgaaccggcaagataatgccgaagttctgtaaataagtaaagatttgcgcgctaaatcgcaacaaacaggttcggcacattactccgaaaacacacggctaagccgcaccaaaagcgcaacgtataagggagcggtgagataaacgatgggcgttacctgacgcgaaaaattccttatcggcagcggggtaatgagcgtaaccaactctgcgaccgcaattataacactctggggagaaatgtgccgaaaacattcattcttgtggtgaaaacaagcatcgtggtacccagaaattattcggcaatcgtccgaggcgcatttgattgagataattaaggtaatcccggcggggaatttcgcaggcaccaagcgatgctgtgtgatcgttaaggacctggcagtcgataagcttaccgccatgaccgataaattcctcacagaataccagaagcgccgttttagacgcattttccatccggctgaacatggactcgccacaaaatagcgttccctgggccacgccgtacataccgccgacaagctcatcttcacgccagacttcaatggagtgggcatggccgagttcgtgaaggcgatggtaggcttcgaccacgccacgcgtgatccaggttccttcttcgcgatcgctggcacagccttcaatgacctgaccaaaagcgtaattcatcgtgacacgatagggcgagcgtttatgaaatcgcttcatactacggctgatatgcagtgattctggccatagcaccgcgcggggatcgggcgaccaccagaggatggggtcgcctggagaaaaccacggaaaaataccacgctggtaagccattaacaggcgcgcagggctaagatcgcccccaagtgccagcaggccgttaggctcacgtaatgcgccttccggggaagggaaggctattgaatggcgagaaagctgaaccaggcgcatgaccgcaaaactccacgcaagtcggatcgttcaataatagcttacaaaccctgcttgaactggtaataacgcccctgtctggcaagcagttctgcgtgagtaccttgctcaataatttgcccgttgtccatcactattatttgttggaaacgagagagtccgcgaagtcgatgggtgaccattaacaccgttttctcacgcatcatttctgcaagcaattcaaggatctggctttcggttgtggcatctaagccttcggtaggttcatccagcaacaccagtggcgcatcatgtaacagcgcacgggcgatagccagacggcgcagttcaccaccggagagctggcgtccgccttcacctaaccaactgttgagacctgcatcctcgagcagcttttccaggccaacgcgacgcaagatctccgacagagcctcatcactactgccaggcgaggcgagtaaaagattatcacgcagcgtggcgctaaacagatgcactcgctgaggaacaacgctgatggtctgtcgtagagccgcttcattcaggctggctatggggctatcgttaagcaaaatctcgccctgttgcgggtcccatgcgcgggtcagctgttgtaacagtgttgatttgccgcatccggttcgcccgagaatcgctatatgttccccggcgtttacctgaagagaaatccctttaagtgcctgttgagattgctccggataagtgaactgaacatcccgtaacgtcagcgaaacgcgatcggcaacacgagtttgggtatcaggaaaggtgacctccggtttttgatccgttaagtcagagatacgtacggcagaggcaatgacttgccccagatgctgaaatgcacccgttactggtgccagtgcttcaaacgcggctaacgcgcagaagacaaacagggcaattaacgcgccgggttgagcattgccgccaacgccgccagacgccatccacagcatcaggatcaccgctaacgcgccaatgagcagcattatcgcttgcgacaatgcggtcagttcagattgacggcgttgcgcttccagccattgaatttctgtattctctagttgcgtgcgataacgatcgctggcaccaaaaatggtcagctcagcttgcccttgcagccaggccgtcagttgttggcgatactgtccgcgaagatgagtcagattttgcccggtgctttttcccgcacgataaaacagcggtggcatcaggaaaagcgtcagtaacataatgccgcccagcgtaaaggcgagggtgaaatcaaggaaacttaacccgattgtcaccaccataatcaccacaaaagcgcccaccagcggcgagataacgcgcaggtaaagatgatcgagcgtatcaacatccgccaccacgcgattgagcaattcgccctgacgatagcgcgccagtccggcaggggagaggggcagcaatttgctgaaggtgtaaatgcgcagatgctgcaacacgcggaaagtcgcgtcgtgacttaccagacgttcaaaatagcgcccggcagtacgggtgattgctgcgccacgcacgcccgcagcgggtagcatatagttgaagctgtacagtccggcaacccccgcaaccgctgaggccgagaggaaccagccggaaagtgtcaacagaccgatactggcgagcagcgtcacaattgccagcacaataccaagacttaacatccatttatgacgtttatacagtgccagatagggtagcaaagcgcgcatttaaatctcctcctgacgatgggccagtaatgtggcgaatgggccaccagccacacttaattccgcgtaacgtccttgctcaataatccggccatcctgcataacccaaatgacatcccagtcagcaagatcttctaactggtgggtgaccattaacgttgtctggcgcagagaggcggcattcagcgcctccattacgcgctgttcactgtgagcatcaaggctggcagcgggttcatccaacagtaatagcgaacagggatttagtaacgcacgggccaccgccacgcgctgcgcctgccccacggaaaggcgggcagcctggtcgccaacaggcgtatcaacgccttgtgggaggagcggtagaaactcgctgacccaggcgttatccagcgctgcttgtaattcttgttcgctggcatcaggtcgcgccagtagtacgttatcccgcaatgttgctgccggtaattgtgggttttgcccaacccaggagagatgtttacgccatgattctggtgataaatcgcgtaattctatcccgttgattcgtagcgatccctgatatgagagaaaaccagaaagcgcgttcagcagtgagcttttacctgaaccgctgcgaccaaccaacaccgcacgttggcctgctggcaaagtaaagttcagcggtccggccagcgttttaccttccggcgacgtgataaacagctcctcggcctcaatggtcaccggatcggtcgatgctaattccgcctcaccacgttgcggatgggcgagcggggtttccataaacgttttcagactgtcagctgcgccaacagcctgggctttagcatgataaaacgtaccgagatcgcgtaatggctggaaaaactctggcgcaaggatcagggccagaaaacccgcagccagcgtcacaccggtatcgtagtgaccaaaatccagctcgccgagataggaaaaaccaaagtagaccgccaccagagcaattgacagcgaggtaaaaaattcgagaatgccggaggataaaaacgccagccgtagcacttccattgtccgttggcggaaatcttccgaagcagaacgaatactttcaatttcagcttcaccacgaccaaaaatacgcaatgtttccatgccgcgcaggcgatcgaggaaatgcccacttaagcgagcaagagcgagaaagttacgtcggttagcatcggcagcccccattccaaccagcgccataaacaacggaattaacggtgcagtgcccagcagaatgagcgccgcagcccagttagaggggaagattgccaccacaatcagcaacggcaccgacactgccagcgccatttgcggcagatagcgtgcatagtaatcatgcatatcgtcaatttgctcgagtaccagcgtcgcccagctccccgcaggtttaccctgaatccacgctggccctgcttgttgcagacggtcgagaacctgacggcggatggcaaagcggatatgctgcccggcgtgataacccacccgttcgcgtaaccagaccacccatgcgcgcagtacaaaggtcagaaccagtaacgtaaagggaagcagcagggcttcacggggaatattctccataatcatatgttgcagaattcgcgccatgaaccaggcctgggcaatgatcaatatgccgctcacaaagcccagcagacgagaaatattcagccaacgttgggagatgacgctttgctgttttaaccagcgggttaactctttttgacgagatttattcattgcacgcttagcaggtgagttatcagaattatttgcagagcaatgttacaacggggaaaaaataaaggcgacccatagtcgcatggtgtcgccttctttacttttgttactgatttgtaaaattattttgcgtcagctaaaccatcgaggtagcgttccgcatcaagtgctgccatgcagcctgtaccggccgaagtaatggcctggcgataaatgtgatccatcacgtcgcctgcggcaaagacgccaggaatgctggtctgggtggcattaccatgaatacccgactgtactttgatgtagccgttttccagttccagctgcccttcgaaaatcgcagtattcgggctgtgaccgatagcaacaaacagaccggcaacgtcgagtgactcgatgttatcgctgttttgcgtatcgcgcagacgaacgccagtgacacccatttgatcgccggtcacttcttccagcgtacggttggtgtgcagaatgatgttgccgttctccactttatccatcaggcgcttaatgaggattttttccgcgcggaaaccgtcacggcggtgaatcagatgcacttccgaagcgatgttagacagatacagcgcctcttcaaccgcggtattgccgccgccgatgaccgcaactttctggttgcgatagaagaaaccgtcgcaggttgcacaagcagaaaccccacggcctttaaaggcttcttcagagggcaggccgagatagcgtgcagaagctccggtggcaataatcagcgcgtcgcaagtgtattcgccgttatcgccattcagacggaacggacggttttgcagatccaccttgttgatatgatcaaaaatgatctcagtttcaaacttggtggcatgttcgtgcatgcgctccattaataacggaccggtcagatcgtttggatcgccaggccagttttccacttccgtggtggtggtcagttggccgcctttttccatgccggtaatcagcacaggttgcaggttggcgcgcgccgcgtagacagcagcggtgtatcccgccgggcctgaacccaggataagcagtttactgtgtttggtcgtgcccatgagatccccatagttgttggcagacaatgggcaggattgtagggaatttacagacgtaaaaaaagagtatgacgattttgttaacaatttgtgcaatcggcagcatcgataagcaggtcaaattctcccgtcattatcacctctgctacttaaatttcccgctttataagccgattaaatgatgaataaacgcccctgttaatgaatatctggcatgttgtactaaaaatcgatgttttgctttgacaatcccctggtgttttgcgaaaacattcgaggaagaaaaaaaacagtattcttatatgcgcataaccatgcatgtaaataccatgtttaccgtgctagtgaaatctacgtatggcgtggacagacgccattcgtgatgtcgatagctgccacaaggcaacggtcttctcaccgtagacccaggcattgcgcgccgtgaatcttcatgatttcggtctatcgtgacgggtagcgactctgaacagtgatgtttcagggtcagacaggagtagggaaggaatacagagagacaataataatggtagatagcaagaagcgccctggcaaagatctcgaccgtatcgatcgtaacattcttaatgagttgcaaaaggatgggcgtatttctaacgtcgagctttctaaacgtgtgggactttccccaacgccgtgccttgagcgtgtgcgtcggctggaaagacaagggtttattcagggctatacggcgctgcttaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtcagcctaccgtaagttgctgggggaaaccctgctgcgtctgcctggcgtcaatgacacacggacatacgttgttatggaagaagtcaagcagagtaatcgtctggttattaagacgcgctaacacggaacaggtgcaaaatcggcgtattttgattacactcctgttaatccatacagcaacagtactggggtaacctggtactgttgtccgttttagcatcgggcaggaaaagcctgtaacctggagagcctttcttgagccaggaatacattgaagacaaagaagtcacattgacaaagttaagtagcggccgccgccttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgttgttcaccggttggtcatgggtgaccattgctgaaaaactcggcggctggattttaaacattctcaccttcgccagtaatcgtacccgtcgcgatgatacctgggtcgatgaagatgagtatgaagacgacgaagagtatgaagatgaaaatcacggcaaacagcatgaatcacgccgtgcccgtattcttcgcggcgcgctagcgcgtcgtaaacggttggcggaaaaattcattaatccgatggggcggcaaacagacgctgcgttgttctccggtaagcggatggatgatgacgaagagattacctacactgcacgcggtgtggctgccgacccggacgacgtcctattttcgggcaatcgtgcaacgcagccagaatatgacgaatacgatccattattaaacggtgcgccaattaccgaacctgtcgctgtagcagctgctgctaccacggcgacacaaagctgggctgcgccggttgaacctgtgactcagacgccgcctgttgcctctgttgatgttccacctgcgcaacctacagtagcctggcagcctgtaccgggtccacaaacgggagagccggttattgctcctgcaccggaaggttacccacagcagtcacaatatgcgcagcctgcagtgcaatataatgagccgctgcaacaaccagtacagccgcagcagccgtattatgcacctgcagctgaacaacctgcgcaacagccgtattatgcccctgcgccagaacaaccggtggcaggtaacgcctggcaagccgaagagcagcaatccacttttgctccacagtctacataccagactgagcaaacttatcagcagccagccgctcaggagccgttgtaccaacagccgcaacccgttgaacagcagcctgttgtggagcctgaacccgttgtagaagagacaaaacccgcgcgtccgccgctttactactttgaagaagttgaagagaagcgagcccgtgaacgtgaacaacttgcggcctggtatcaaccgattccagaaccggttaaagaaccagaaccgatcaaatcttcgctgaaagcaccttctgttgcagcagtacctccagtagaagccgctgccgctgtttccccgctggcatctggcgtgaaaaaagcgacactggcgacgggggctgccgcaaccgttgccgcgccagtcttcagtctggcaaatagcggtggaccgcgtcctcaggtcaaagaggggattggtccgcagttgccacgaccgaaacgtatccgcgtgccaactcgtcgtgaactggcgtcttacggtattaagctgccctcacagcgtgcggcggaagaaaaagcccgtgaagcccagcgcaatcagtacgattctggcgatcagtacaacgatgatgaaatcgatgcgatgcagcaggatgaactggcacgtcagttcgcccagacacagcagcaacgctatggcgaacagtatcaacatgatgtgcccgtaaacgcagaagatgcagatgctgcggcagaggctgaactggctcgtcagtttgcgcaaactcaacaacaacgttattccggcgaacaaccggctggggcgaatccgttctcgctggatgattttgaattttcgccaatgaaagcgttgctggatgatggtccacacgaaccgttgtttacgccaattgttgaacctgtacagcagccgcaacaaccggttgcaccgcagcagcaatatcagcagccgcaacaaccagttccgccgcagccgcagtatcagcagccacaacagccggttgcgccgcagccacaatatcagcagccgcaacaaccggttgcgccacagcagcaatatcagcagccgcaacaaccggttgcgccgcagcagcagtatcagcagccacaacagccagttgcgccacaaccgcaggataccctgcttcatccgctgttgatgcgtaatggcgacagccgtccgttgcataaaccgacgacgccgctgccttctctggatttgctgacaccgccgccgagcgaagtggagccggtagatacctttgcgcttgaacaaatggctcgcctggtggaagcgcgtctggctgatttccgtattaaagccgatgtcgtcaattactctccggggccggttatcactcgctttgaattgaacctggcaccgggcgtaaaagcggcgcgcatttctaacttgtcacgggaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaaatctgtcggtgtgaacgcgatgatcctgagcatgctttataaagcacagccagaagatgtgcgtttcatcatgatcgacccgaaaatgctggagctttcggtttatgaaggcattccgcatctgttaacggaagtcgttactgatatgaaagatgccgccaacgcgctgcgctggtgtgttaacgagatggagcgtcggtataaactgatgtctgcgctgggtgtgcgtaatctggcgggttataacgaaaaaattgctgaagccgatcgcatgatgcgtccgattccagacccgtactggaagccgggtgacagtatggatgcccagcatccggtgctgaaaaaagaaccatacattgtggtgttggttgacgaatttgccgacctgatgatgacggtaggtaaaaaagtggaagagctgatagcacgtctggcgcaaaaagcccgtgccgcgggtatccacctcgtactggcaactcagcgtccatcggttgatgttattactggtctgattaaagcgaatattccgacccgtatcgcctttaccgtatccagtaagattgactcacgtaccattcttgatcaggctggcgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagcgaaagcgaaggtggtgcgggtggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggtaatcgtgaagtgctggccccaccgccgtttgactaactaatgcatcgtatgccggataaggcgcggtagcgtcgcatccggcactctatcaactgaaaattcagtattttcttctttcctcaagctgattattagcctggaatagagagtagagggaactcccgatcgggagtgacgtaatttgaggaataatgatgaaaaaaattgccatcacctgtgcattactctcaagcttagtagcaagcagcgtttgggctgatgccgcaagcgatctgaaaagccgcctggataaagtcagcagcttccacgccagcttcacacaaaaagtgactgacggtagcggcgcggcggtgcaggaaggtcagggcgatctgtgggtgaaacgtccaaacttattcaactggcatatgacacaacctgatgaaagcattctggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgtcctgacgccgaaagccagcaatggcaatctgaagcagttcaccattaacgtgggacgtgatggcacaatccatcagtttagcgcggtggagcaggacgatcagcgcagcagttatcaactgaaatcccagcaaaatggggctgtggatgcagcgaaatttaccttcaccccgccgcaaggcgtcacggtagatgatcaacgtaagtagaggcacctgagtgagcaatctgtcgctcgatttttcggataatacttttcaacctctggccgcgcgtatgcggccagaaaatttagcacagtatatcggccagcaacatttgctggctgcggggaagccgttgccgcgcgctatcgaagccgggcatttacattctatgatcctctgggggccgccgggtaccggcaaaacaactctcgctgaagtgattgcccgctatgcgaacgctgatgtggaacgtatttctgccgtcacctctggcgtgaaagagattcgcgaggcgatcgagcgcgcccggcaaaaccgcaatgcaggtcgccgcactattctttttgttgacgaagttcaccgtttcaacaaaagccagcaggatgcatttctgccacatattgaagacggcaccatcacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcactgcataagtcggtacgtggtagcgcacccgatgcggcgctgtactggtatgcgcgaattattaccgctggtggcgatccgttatatgtcgcgcgtcgctgtctggcgattgcgtctgaagacgtcggtaatgccgatccacgggcgatgcaggtggcaattgcggcctgggattgctttactcgcgttggcccggcggaaggtgaacgcgccattgctcaggcgattgtttacctggcctgcgcgccaaaaagcaacgctgtctacactgcgtttaaagccgcgctggccgatgctcgcgaacgcccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaatgttatcgttgcggtaatgttgttactgtatccctgtggtcgcaggctgtggccacatctcccatttaattcgataagcacaggataagcatgctcgatcccaatctgctgcgtaatgagccagacgcagtcgctgaaaaactggcacgccggggctttaagctggatgtagataagctgggcgctcttgaagagcgtcgtaaagtattgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctgaccatccctaacctgcctgcagatgaagtgccggtaggtaaagacgaaaatgacaacgttgaagtcagccgctggggtaccccgcgtgagtttgactttgaagttcgtgaccacgtgacgctgggtgaaatgcactctggcctcgactttgcagctgcagttaagctgactggttcccgctttgtggtaatgaaagggcagattgctcgcatgcaccgcgcactgtcgcagtttatgctggatctgcataccgaacagcatggctacagtgagaactatgttccgtacctggttaaccaggacacgctgtacggtacgggtcaactgccgaaatttgctggcgatctgttccatactcgtccgctggaagaagaagcagacaccagtaactatgcgctgatcccaacggcagaagttccgctgactaacctggtgcgcggtgaaatcatcgatgaagatgatctgccaattaagatgaccgcccacaccccatgcttccgttctgaagccggttcatatggtcgtgacacccgtggtctgatccgtatgcaccagttcgacaaagttgaaatggtgcagatcgtgcgcccagaagactcaatggcggcgctggaagagatgactggtcatgcagaaaaagtcctgcagttgctgggcctgccgtaccgtaaaatcatcctttgcactggcgacatgggctttggcgcttgcaaaacttacgacctggaagtatggatcccggcacagaacacctaccgtgagatctcttcctgctccaacgtttgggatttccaggcacgtcgtatgcaggcacgttgccgcagcaagtcggacaagaaaacccgtctggttcataccctgaacggttctggtctggctgttggtcgtacgctggttgcagtaatggaaaactatcagcaggctgatggtcgtattgaagtaccagaagttctgcgtccgtatatgaacggactggaatatattggctaatacccaatttttctgaatctaaaaagcgcctgcgggcgctttttttgtctccctttgataccgaacaataattactcctcacttacacgtaatactactttcgagtgaaaatctacctatctctttgattttcaaattattcgatgtatacaagcctatatagcgaactgctatagaaataattacacaatacggtttgttactggaatcaatcgtgagcaagcttgagtgagccattatgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgccattccaacaaaatcagacgaaaaggttatctggagcgcctgtacagttaactgtggtagtcgctgcccgctacgtatgcacgtcgtggacggtgaaatcaaatatgtcgaaacggacaataccggcgatgacaattacgacggcctgcaccaggttcgcgcctgcctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaatatgcagcgcctgatcaaagagtacggcaacgagtctatctatctgaactatggcaccggtacgctgggcggcaccatgacccgctcctggccgccgggaaataccctggtcgcgcggctgatgaactgctgcggcggctatctgaaccattacggcgactactcctccgcgcaaattgcggaaggtttgaactatacctacggcggctgggcagatggcaacagcccgtcggatatcgaaaacagtaagctggtagtgctgtttggtaataaccctggcgaaacgcgaatgagtggcggtggggtgacttactatcttgaacaggcacgccagaaatctaatgcccgcatgatcatcatcgatccgcgctataccgacaccggtgccgggcgcgaagatgagtggatccctattcgtccgggaacagatgccgcactggttaacggtctggcgtacgtcatgatcactgaaaacctggtggatcaggcattcctcgataaatattgcgttggctacgatgagaaaaccctgccagccagtgcgccgaaaaatggccactataaagcttatattctgggtgaagggccagatggcgtggctaaaacgccggaatgggcctcgcaaatcactggtgttccggcagacaaaatcatcaaattggctcgtgaaatcggtagtaccaaaccggcgtttatcagccagggatggggcccgcagcgtcacgctaacggtgaaatcgcaacccgtgctatctcgatgctggcgattctgaccggtaacgttggtattaacggaggcaacagcggcgcgcgtgaaggttcatacagcttaccgtttgtccgtatgccgaccttggaaaacccgatccagaccagcatttcgatgtttatgtggaccgatgccattgaacgtggcccggaaatgacggcgctgcgtgatggtgtacgcgggaaagataagctggatgtgccgatcaaaatgatctggaactatgccggtaactgcctgattaaccagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcgctggatgcatcctgcgggaatatgtcttacgtgattttcaacgatcaggtgattaaaccgcgctttgaatgtaagaccatctatgaaatgaccagcgaactggcaaaacgtcttggcgttgagcaacagtttactgaaggccgtacccaggaagagtggatgcggcatctgtatgcccagtcgcgggaagcgattcctgaactgccaacgtttgaagagttccgcaagcaggggatctttaaaaagcgcgacccacaagggcatcacgttgcttataaagccttccgtgaagatccgcaggcaaacccactgactacgccatcgggcaaaattgagatttattcgcaggcgctggctgacattgccgctacctgggaattgcctgaaggcgatgtgatcgatccactgccgatctacacgccgggctttgaaagttatcaggatccgctgaacaaacagtatccgctgcagcttacaggtttccactataaatctcgcgttcactcaacttacggcaacgttgatgtgctgaaagcggcttgccgtcaggaaatgtggatcaacccgcttgatgcccaaaaacgcggtatccacaacggcgataaagtcaggatctttaacgatcgtggtgaggttcatattgaggcgaaagtgacgccacgaatgatgccgggtgtggtcgcactgggtgaaggtgcctggtatgacccggatgcaaaacgtgtcgataagggtggttgtattaacgtactgaccactcaacgtccgtctcctctcgctaaggggaatccgtcacatacaaaccttgttcaggttgaaaaggtgtaaggagtaaccgatgacaacccagtatggattttttattgattccagccgttgcaccggttgcaaaacctgcgagctggcctgtaaagactacaaagatttgacgccagaagtcagcttccgccgcatttatgaatatgctggcggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcgatggttgttatgaccgtgttgcggagggtaaaaagccgatctgtgttgaatcttgtccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtgagatgggaagtggatggcatgaatggccgctgatgatcttcacggtcttcgggcaatgtgtagcaggtggttttatcgttctggctttggcgctgctcaaaggcgacctgcgagcagaagcccagcagcgtgttatcgcctgcatgtttggtttatgggtgctgatgggcattggctttatcgcctctatgctccatcttggttcaccaatgcgcgcttttaactcgctcaaccgggtaggggcttcagcactcagtaacgaaatcgccagcggttcgatcttttttgccgtaggcggcatcggctggttgctggcaatgctgaaaaagctgtcaccggcattgcgtacgctgtggctgatagtgacgatggttcttggcgtcatctttgtctggatgatggtgcgtgtgtataacagcattgataccgttccgacctggtacagcatctggacgccgatgggcttcttcctgacgatgtttatgggcggcccgttactgggttacctgttgttgagtctggctggcgtcgatggctgggcgatgcgtctgctgccagcaatttctgtactggcactggtagtgagtggcgtggtgtcagtgatgcagggcgcagagctggcgactattcatagttctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgcggcgtattctatggtttgcatatgaccgtggggatggccgtcgcaagctaatcataacaaccggggtttcggccccggttctcttttatttctgcttcgttaacgtgtcataactggtcatcaaattacgataatcaggaatgtggttagagaacaacgtcgccagtccttcaatatcattacgccagtcgcgatgcagctcgcacgccacgccgaaccatgtcatcaattgcgcaccagcttgcgacaagcgatcccatgccgaatgccgggtaatttcattaaaggtccctgacgcgtcagtcacgacaaagacgtcaaacccttcttcaatggctgaaagcgccgggaatgccacgcaaacttcggttaccacaccggcaataattaactgttttttacctgtcgctttgacagcttttacaaaatcttcgttatcccaggcgttaatatttcccgggcgagcaatgtaaggtgtatcggggaattgtgctttcagttctggaactaatgggccgttaggaccggtttcaaaactggtggtaagaatagttggtaagttgaaatacttagccaggtcacccagcgccagcacgttatttttaaacttatcgggttcgatatcccgtacaagggaaagtaaaccagcctggtgatcaacaagcaaaacggcagcatcatttttatcaagacgaacatacggtttggtcatcctcttctcctttcgagagtcagtggtacgtctgaaatcgatcagacgcgatgcattgctctgaaagcatagacgggaaatatgagtttgctgtgaccatgaaatttttcgactgaacgaagcgtatgaaatttgtgttagttcaataaaaacaatcagatgagactaatcatctcttcagcattagcgttatgaatgagtaatataaatcgataataccgccgctgggatatcgcgtattttcacccattgacaatgtttttggcggtggcatgatgcgcatgaaatttgaacttcctcacggttttaattcatgtccacgtatacccagcctgtcatgcttttgctgtctggcctgcttttgttgactctggcgattgcggtgttaaatacactcgtgccgctttggctcgcccaggaacacatgtccacatggcaggtaggcgttgtcagctcatcctattttaccggcaaccttgtcggtacattgctgacagggtatgtcattaagcgcattggctttaaccgcagctattatctggcctccttcatttttgccgctggctgtgccggccttggcctgatgattggattctggagctggttggcttggcgttttgtcgcgggcgtcggctgtgccatgatttgggtggttgttgagagcgcgctgatgtgcagtgggacgtcacgtaaccgtgggcgtttgcttgctgcgtatatgatggtttattacgtgggaacgtttttaggccagttactggtcagcaaagtttcaaccgagctgatgtccgtattgccgtgggttacaggtttgacgttggcagggatcttaccgctgttgtttacgcgtgtgctgaatcagcaggctgaaaaccatgattcgacgtcaattacgtcaatgctaaaactccgtcaggcgcggcttggcgtgaatggctgcattatctcaggaatcgttctgggatctctatatggcctgatgccgctgtacctcaatcacaaaggggtgagcaatgccagcattggtttctggatggcggtactggtcagtgcgggtatccttggacaatggccgattggacgtctggcggataagtttggtcgactgctggtgttgcgtgttcaggtctttgtcgtcattctcggcagtatcgcgatgcttagccaggcggcgatggccccagcgttattcatcctcggtgccgctggctttacgctatatccggtggcgatggcatgggcttgcgagaaagttgaacatcatcaactggtggcgatgaaccaggccttactgttgagctatactgtgggaagtctgcttggcccgtcatttaccgctatgctaatgcagaatttctccgataatttattgtttatcatgatcgccagcgtatcgtttatctatttgctgatgctgctgcgcaacgccggtcatacgccgaaacccgttgctcacgtgtaaatgaattcaagcagagtgtgaacttactgtttcacactctgcttttttgtttcttctatctgacttgctttattccaaattttattcgtttaaaaataaaatgtgcagcaggttataattttgcatttcgctatttccgcacttcttatttgccgcgcataatccctcgttttaccgatgcccctttaattttggcgaaggatttgtctatggctgggaatgttcaggaaaaacagttgcgatggtacaacattgcgctgatgtcttttatcactgtctggggttttggcaacgttgttaataactatgccaaccaggggctggtggttgttttttcatgggtgtttatctttgcactctatttcacaccttatgcgctaattgttggtcagttaggctcgaccttcaaagatgggaagggcggggtcagtacctggattaaacacacgatgggacccggactggcttatctcgccgcgtggacctactgggtggtgcatattccctatctggcacaaaaaccccaggcaattctgattgcgctcggttgggcgatgaaaggcgacggttcgctaatcaaagaatattcagtcgtagcgttacaggggttaacgctggtgctgtttatcttctttatgtgggttgcttcacgcggtatgaaatcgctgaaaatcgtcggttctgtggcagggattgctatgtttgttatgtcactcctgtatgtggcgatggcggtaaccgcgcctgcaattactgaagtgcatattgcgaccacaaacattacctgggaaacgttcattcctcatatcgactttacctacattaccactatttcaatgctggttttcgcggttggcggagcagagaagatttctccttacgttaatcaaacgcgcaacccaggaaaagaatttccaaaagggatgttatgcctggcggtgatggttgcggtttgtgccattctgggctcgctggcgatggggatgatgtttgattcgcgtaatatcccggatgacttaatgaccaacggtcagtattacgcctttcagaagctgggcgagtattacaacatgggtaatactttaatggtgatttacgccattgcgaataccctgggacaagtagcggcgctggtattctcgattgatgccccgcttaaagtgctattaggtgatgctgacagcaaatatattccagccagtttatgtcgtaccaacgcttctggtacgcccgttaatggctattttctgaccctggtactggtggcgattctgattatgctgccgactctcggcattggtgatatgaacaatctctataaatggctgttgaaccttaattcggtagtgatgccgctgcgttatttatgggtatttgttgcatttattgcagtcgttcgcttggcgcagaaatataaaccagaatatgtctttattcgtaataagcctctggcaatgaccgtcgggatttggtgttttgcctttaccgcctttgcctgtttgacggggatcttcccgaaaatggaagccttcactgcagagtggaccttccagttggcgctgaatgttgcaacgccgtttgtgctggtaggattaggactgatattcccgctgctggcgcgtaaagcgaatagtaaataattattgtggtcggtgacgctgactctggcagatctgacccgtttttacataatcgagaaatgcgcgcaagccgcaggacatatactggcggtttggataatagatctggaagcctggacgctctgtgctccagtcttccagtacacattctaaacgaccagtatcaaggtactccttgatctgttcatagagcagatacccgataccagcacccatcaaaacggcctccagttcagcatcaacatcatccagaatgatatttcctgcgacagcaatttccagctcctttgcaaattgccagtggaaaggtttgccgctgggataacgaaaaacaacacattgatgattaagcagatcatgaggatggcggggtttgccatatcttgcaaagtactctggcgttgctgctacacataatttcactggcgggccgatcgccacgctgatcatatctttttcgacgatgcaactaagtcgaacgccagcgtcaaagccctgttggacgatatcgacaagagagtcgtcagttgtgagctcgactttaatatcaggatattcacgtgtgaaaccaaccagtaaagacattaaaaatatacgtgcagctacccgggcggcattgattttgagcgttcctgtcggtgtcagacgaaaatcattcatctcatctaacatgatctgaatttcgtcgaaagctgggcgcaatcgttcatagagattagaacccgcttccgttaacgatacgcttcgggttgtccgattgaataagcgaattttaagacgttgttccagtgttttaatactatggctaatggcggacgaggataagcctaactcatcgcccgctgcacgaaagctttgattacgggccacggcaaagaaagtggcaaagtcagacatattcatccgcattagtgaaaatccttcattaactcatcctgaatcatcacgtttacaggattatgccgcctgcgtaaagtgcgctccagaacttaacgtggaggtaaaattatgcagtctgaacgtatttatttggtatgggcccatcctcgtcatgattcattgaccgcacatattgctgatgcgatccatcagcgggcaatggagcggaaaatacaggtgacggaactcgatttatatcggcgtaatttcaacccagtgatgacgccggaagatgaaccagactggaagaatatggataaacgttattctccagaggttcatcagctttattcagagctgcttgaacatgacacgttagtggtggtttttcctctctggtggtacagcttcccggcaatgctaaaaggatatattgacagagtatggaataatgggctggcttatggagatgggcacaaattaccattcaataaagttcgttgggtggcgctggttggaggagacaaagaatcatttgtccagatgggctgggaaaaaaatataagcgattatttaaaaaatatgtgcagttatcttggtattgaagatgccgatgtcactttcttgtgtaatacagtggtattcgatggggaagaacttcacgcgagctattatcagtcgttattatctcaggtacgggatatggtagatgcactataagatgtgttaaaaacgctgtagcagaatgaagcgcggaataaaaaagcggcaactcaataaagttgccgctttacggggaaattagaacattaccttatgaccgtactgctcaagaatgcctttcacgcgttccatggtctctttcttcggtggtttaacaccgtcgagtttgtactcttcacccattgccacccatttgtgtttgcccagctcgtggtaggggagaagctcgattttctcaacgttgcccatatcacgggtaaattcaccgaggcgatgcgctgaatcgtcatcgtcagaccagcctgggacaacaacgtagcggatccacaccttcacatttttgttcgccagatatttagcgaactccagcgtgcggtggttggaaactccaaccagattttggtggatctcgtcgttcatctgtttgagatcgagcattaccaggtcggttacttccagcagttcatcaatcaccggatcgtaacgacgaacaaaaccgttggtgtccagacaggtatgaatgccttcttttttgcaggcgcggaaccagtcacgaacaaactcagcttgcaggattgcttcaccgccggatgcggtaacgccgccgccggaagcgttcataaagtggcgataggtcaccacttccttcatcaaatcttcaacggtaacttctttaccgccatgcgtgtcccaggtgtcgcggttatgacaatacaggcagcgcatcaggcagccctggaaaaaggtgataaagcgaatacctgggccgtctacggttccacaggattcaaaggagtgaatgcgaccaataactgacattgcggtgtttctccagatgtggcccatctgaggccgtgttggtgcgcagctcgaaggctacgtcgagtctgttttggcagtcaccttaaagtatagatagctgacaaaaaaggctctcgcgctaaaaaaggccccactttcgtggagcctttattgtacgctttttactgtacgatttcagtcaaatctaattacatagattgagtgaaggtacgagtaataacgtcctgctgctgttctttagtcagcgagttgaaacgtactgcgtagccagatacacggatggtcagctgcggatatttttccgggttttccatcgcgtcgagcagcatttcacggttcatcacgttaacgttcaggtgctgaccaccttcgatggatgcttcgtggtggaagtaaccatccatcagaccagccaggttggtcttacgaacttcgtcgtctttacccagtgcgttcggaacgatagagaaggtgtaggagataccatctttagcgtaagcaaacggcagtttagcaacggaagtcagagaggctactgcacctttctggtcacgaccgtgcatcgggttagcacccggtccgaacggcgcgccagcacgacgaccgtctggggtgttacccgttttcttaccatacacaacgttagaagtgatggtcagaacagactgagtcgggatagcgtcacggtaggtgtgcagtttctgaattttcttcatgaaacgttctaccaggtcaacagccaggtcatctacacgcggatcattgttaccaaactgcgggtattcgccttcgatttcgaagtcgatagccagaccgtcttcgtcacgaatcggtttaactttcgcatatttgattgcagacagggagtcagcagcaacggacagaccagcgataccacacgccatggtgcggataacgtcacggtcgtgcagcgccatcagagaggcttcgtagctgtacttgtcgtgcatgtagtggatgatgttcagtgcagtgatgtactgtttagccagccagtccatgaagtgatccatgcgctccatcacttcatcatagttcaggacatcgcctttgatcggttcagacttcggaccaacctgcattttcagtttttcgtcaacgccgccgttgattgcgtacagcatggttttcgccaggtttgcacgcgcaccgaagaactgcatttgtttaccaacgatcatcgggcttacgcagcaagcaatagcgtagtcatcgttgttgaagtccggacgcatcaggtcatcgttctcatactgcagagaagaggtgtcgatggacactttagcggcgaatttcttgaagttcagcggcagtttttcagaccacagaatggtcatgttcggttccggagacggacccatggtgtacagggtgttcaggaaacggaagctgtttttggtaaccagggtacgaccgtcgaggcccataccaccgatagattcggttgcccagatcgggtcgccagagaacagttcatcgtattccggagtacgcaggaagcgaaccatacgcagtttcatgaccaggtggtcaaccatttcctgcgcttcttgttcggtgatcttgccagctttcaggtcacgttcgatgtacacatccaggaaggtggaggtacgaccgaaggacattgcagcaccgttctgagacttaacagcagccaggtagccgaagtaagtccactggatagcttcctgagcgttggtagccggaccagagatgtcgtagccgtatttcgcagccatttctttcatctgacccagagcgcggtgctgttcagcgatttcttcgcgcagacggatagtctgttccaggtttacgccgttttccagatcagcctgcagagaagtgaactgtgccagtttgtctttcatcaggtagtcgataccgtacagcgcaacgcgacggtagtcaccgatgatacggccacggccatatgcatctggcagaccggtcagaacaccagatttacggcaacgcaggatgtccggagtgtaaacgtcgaacacgccctggttgtgagttttacggtattcagtgaagatttttttgatcatcggatccagttcgcggttgtacgctttgcaggaaccttcgatcattttgataccaccgaacgggataagagcacgtttcagcggagcttcagtctgcagaccaacgattttctcaagctgcttgttgatgtagccagcgtcgtgagaggtgatggtggaagcaacagcggtgtcaaagtcaactggcgcgtgagtgcggttttccagtttaacgccttccattactttgtcccacagggtggtggtcgcttcagtagcgccagccaggaaggactcgtcaccctcgtacggagtgtagtttttctgaatgaagtcacggacgtttacttcattctgccagtcacctttggtaaaaccttcccaggctgtggctaacttttcattaagctcggacatgtaacacctaccttcttaagtggattttttatttactgcgtacttcgacaaccattaatggtggtcgttttcacgcaggtaaatgacccagtatgtcaacccaaccaacaaaccaccaccgataatgttgccgatcgtaaccggaatcaggttatcagtgatgaaattcatcacggtcaggtgagaaaaattttccggtgcagaaccgactgcggtccaaaattccggggatgcgaagtcgcggattacaatacccatcgggatcataaacatgtttgcgatactgtgctcaaaaccgctggcaacaaacatcgcgaccggcagcaccataatgaacgctttgtccatcaggctgcggccagaataactcatccatactgccagacataccatcaggtttgccaggataccaagacagacggcctcaataaaagtatggtgcactttgtggtcggcggtttgtaggacgtttagtccccattgaccatttgcggtcatatactcgccggaaagccacattaaaagtacaaacagcagtgcgccgaccaggttgccaaaatagacatttagccagtttttcgccaactgaccccaggtgatgcgcccactcgccttagcaacaacaatcaacacggtggaagtaaagagatcggctccgcagacaacacaaagaatcagccccagagagaagcaaatgccgccaaccagttttgccatgccgaagggcattgtgcctgtgccagtggttgctgtgatatagaagacgaatgcgattgagatgaaaacaccggcggtaatcgccagatagaaagtcttaagcggatgtttcgttgctttatagacacccgcctcttcggccactttggccattgcagcaggaagtaaaagatcaaaagggttgtcagctttcacactaactctctctttattaagtcggcgacgagatactaacaaagcattatagatgagaaattgatatagatcatatctcgcctggcttataggcccgtaactcgcatggtttttatgcaaatacggagtaaatatttgattatccaaataaaaataaattttaaaaattaacaaatgagttgaattttttccgcatcctccgctaaaacagttaattaaaagggagcatcaggcgaataaagtaacaatatcgatcgtatttattaaatacaaattaccgatatttaaccttataattacaattattttattaatgcaaatatatgtaaagcggggcattaaaaaaacgccccgtaatataactcagactaatcattaagcctacattgcgtaggctatttgattttattttgcccagaatgctgctttggcgcgctgcagcttttcgtaggccttcaacaacgactgatgtgcagcaaacgcgtgcagatcgctatctaccggttgcaggccgtaaaacgccgcttcgccgctcattgccgcactggcggcttctacggcatctgcgccgtacatgcgaacaaacgcattcagatattgcagcggctggcgatcttcttcctgtgccagtaataacaacgtttgcaggcagcgataatagttggcgcgttccggactaaatactgatgagttaaactccatcgtccattcggtccagaccagagcctgttccagatcgccaccagccagcgccagcatggcttttaattcaccgatacgcagggtgtaccaaccgttatccgacccggtcgccagacccaacagctcacgcacgcgggtaaagtcatcaaaaccttcttcatccagttgctcgatgaggttcaggtaatcttctttttcccactcgctgcctggtagcgaaagaatcgtttcacgtaaatggctgcccatactgttattcgcgagccacagatcttcagccggataaatatcggacatgccaggcacgataatacggcaagcataaacgcccagatgctcgtaatcggcaatataaacttctttatcttctttgttgaagatagccatcagtgtggcgaactcttcttccgtggtgccggagaaattccagtccacaaacggataatcggcatcctgcttgaacaggtcccaggagattaaaccgctggaatcgataaagtgcgtttcgaggttggtatgttcagcgacttcttcatcatcgaaggttggcggagtaaacacatccaaatctttcaggccacgaccttgcagcagctcggtcacggtacgttccagtgctacgccaaaatcaggatgcgcaccgaaagaggcaaagcaggtaccgttagcaggattgaacagtaccacgcaaatcaccggatactggccgccaagcgaaccgtcataagcgaagattgggaaaccctccgcttccagcgtttcgatggcttcaactactgctgggtaacgcgccagcacgtctgccgggatctctggcaggctgatgctttcagcaataatgcggtttttcacgtagcgttcgaaaacttcagacaatccctgaacgcgtgcttcgttgcgggtattacctgcggacataccgttggagacgtacaggttaccaatgatattcatcggaatataaacggtctgattgtcggactgacgcgtaaacggcaggccgcaaataccacgatcttcgttaccggattgtaggtcaatcagcatgctgccggtcagttcattctccggatcataaaacgcgcgcagacggtcatcgagcagcccttctggcacatcgtcattttcggtcagtgggaaccatttttcgttgggataatgcacgaacggaccgttggcgatggtttcgcccagccagaagtccgcaaaaaagtagttggttgagagacgctcgaaatattcaccgagtgcagaagccagcgccgctttcttggttgcgcctttaccgttggtaaaacacagtgcgcactctttgtcgcgaatatgtacagaccagacgttaggcacgggattcagccaggaggcctcttcaatctgaaagccgaggtctgaaagtttttgctggaagcgagcgatggaatcttccagagcggcatctttgccggggataaatgtttgcgtcatgaaaatcactttagtcgtacggaaagcgcgcaataatacgggttttatctcaaaggcgctatcaccgccgccatgccgatgaactgttgactatgcttttagcggataaaccacgttaagagcataaaaatgaaggcgttcgatctccaccgtatggcatttgataaagtgccttttgatttccttggcgaagttgcactacgtagtctttatacctttgtactggtctttttgttcctcaaaatgaccggaagacgcggtgtgcggcagatgtcgctgtttgaagttttaatcattctgacgctgggatcagcggcgggagatgtggcgttttatgatgatgtgccgatggtcccggtacttatcgtctttattactctggcgttgttataccgcctggtaatgtggttgatggcgcacagtgaaaaactggaagatcttctggaaggcaagccagttgtcattattgaagatggcgagctggcctggtcgaaactcaataactccaacatgacggaatttgagttctttatggagctacgattgcgtggcgtggagcagctggggcaggtacgtctggcgattctcgaaaccaacgggcaaatcagtgtctatttctttgaagatgacaaggtgaaaccgggtttacttattttacccagtgattgtacgcagcgttacaaagtggtgccggagtcggcggactatgcctgtattcgttgtagtgaaatcattcatatgaaagcgggggaaaaacaattatgtccgcgctgtgcaaatccagaatggacgaaggcaagtcgggcaaaacgggtgacctgacagtaaaaacatcggctttttgctaataatccgagagattcttttgtgtgatgcaagccacatttttgccctcaacggttttactcattgcgatgtgtgtcactgaatgataaaaccgatagccacaggaataatgtattacctgtggtcgcaatcgattgaccgcgggttaatagcaacgcaacgtggtgaggggaaatggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaatgtcccctccaactacaaggtattattctgccatggcggtggtcgcggtcagtttgctgcggtaccgctgaatattctcggtgataaaaccaccgcagattatgttgatgccggttactgggcggcaagtgccattaaagaagcgaaaaaatactgcacgcctaatgtctttgacgccaaagtgactgttgatggtctgcgcgcggttaagccaatgcgtgaatggcaactctctgataatgctgcttatatgcattattgcccgaatgaaaccatcgatggtatcgccatcgacgaaacgccagacttcggcgcagatgtggtggtcgccgctgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaagcgaacggcggtgtagctgaaatggataaaatcaatcagcaaaaagcagaactgctatatggggtgattgataacagcgatttctaccgcaatgacgtggcgaaagctaaccgttcgcggatgaacgtgccgttccagttggcggacagtgcgcttgacaaattgttccttgaagagtcttttgctgctggccttcatgcactgaaaggtcaccgtgtggtcggcggaatgcgcgcttctatttataacgccatgccgctggaaggcgttaaagcgctgacagacttcatggttgagttcgaacgccgtcacggttaatgccgaaattttgcttaatccccacagccagcctgtggggtttttatttctgttgtagagagttgagttcatggaatccctgacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggcggtccattacacgcagaaggtgccctggagttgttcctcggtaacgccggaacggcaatgcgtccgctggcggcagctctttgtctgggtagcaatgatattgtgctgaccggtgagccgcgtatgaaagaacgcccgattggtcatctggtggatgcgctgcgcctgggcggggcgaagatcacttacctggaacaagaaaattatccgccgttgcgtttacagggcggctttactggcggcaacgttgacgttgatggctccgtttccagccaattcctcaccgcactgttaatgactgcgcctcttgcgccggaagatacggtgattcgtattaaaggcgatctggtttctaaaccttatatcgacatcacactcaatctgatgaagacgtttggtgttgaaattgaaaatcagcactatcaacaatttgtcgtaaaaggcgggcagtcttatcagtctccgggtacttatttggtcgaaggcgatgcatcttcggcttcttactttctggcagcagcagcaatcaaaggcggcactgtaaaagtgaccggtattggacgtaacagtatgcagggtgatattcgctttgctgatgtgctggaaaaaatgggcgcgaccatttgctggggcgatgattatatttcctgcacgcgtggtgaactgaacgctattgatatggatatgaaccatattcctgatgcggcgatgaccattgccacggcggcgttatttgcaaaaggcaccaccacgctgcgcaatatctataactggcgtgttaaagagaccgatcgcctgtttgcgatggcaacagaactgcgtaaagtcggcgcggaagtggaagaggggcacgattacattcgtatcactcctccggaaaaactgaactttgccgagatcgcgacatacaatgatcaccggatggcgatgtgtttctcgctggtggcgttgtcagatacaccagtgacgattcttgatcccaaatgcacggccaaaacatttccggattatttcgagcagctggcgcggattagccaggcagcctgaatgaacaacgggcaataaatagccaaatctttctttatcaaaacgtcggcacattgtcggcgttttttttcggaccttgtgagtcattttgattaatggtagcgtcgcttgtcaatgtaagttgttgatacataatatttatatatgattaatcaacggatgattcacatgaagaatactaaattactgctggcgattgcgacctctgcagcattactgacagggtgtcaaaatacccacggtattgataccaatatggctatcagctccggtttaaatgcctataaagcagcaacattaagcgatgccgatgcaaaagcgattgccaatcagggctgtgccgaaatggacagcggcaatcaagtcgcaagtaaatccagcaagtacggtaaacgtctggcaaaaatcgccaaagcattgggtaacaatattaatggcacgccggtcaactataaggtttatatgaccagcgacgtcaacgcatgggcgatggcgaacggctgtgttcgtgtctacagtggcctgatggacatgatgaatgacaacgaaattgaaggcgttctgggccatgaactgggccacgtcgcgttgggtcactcgctggctgaaatgaaagcttcttatgcgatcgttgccgcacgcgatgccatttcagctaccagcggtgtggcttcccagctttcccgctcacaattaggtgatatcgcagaaggcgctatcaatgctaaatactcccgtgataaagagtccgaagcagatgatttctcctttgatctgttgaagaaacgtggcatcagcacccaggggctggttggcagctttgaaacactggctagcctggatggcggtcgcacccagtccatgtttgactctcacccaccatcaacagagcgtgcgcaacacatccgtgatcgtatcgcctctggtaagtaaatcattgtcatctttcgggctggtcttctgccagcccgctataattgcgcaataaatccccatctgaatacagacaaaactggtttttgcacacaacgttaacgatttgtggcgtcggcgcgtataatgcgcgcggttatgttaacggtacgcctgttttaaggagataaagatgacggcaattgccccggttattaccattgatggcccaagcggtgcagggaaaggcaccttgtgtaaggctatggcggaagcgttgcaatggcatctgctggactcgggtgcaatttatcgcgtactggcattggcggcattacatcaccatgttgatgttgcgtcggaagatgcgctggtaccgctggcatcccatctggatgtacgttttgtgtcgaccaatggcaatctggaagtgatcctcgaaggggaagatgtcagcggcgaaattcgtactcaggaagtggcgaatgcagcttcacaagtcgcggcattcccacgcgttcgtgaagcattattgcgtcgccaacgcgcgtttcgcgaattaccaggtctgattgccgatggccgcgacatgggaacggtggtattccctgatgcaccagtgaaaattttccttgacgcctcctcggaagaacgtgcgcatcgccgcatgctacagttgcaggagaagggctttagtgttaactttgagcgccttttggccgagatcaaagaacgcgacgaccgcgatcgtaaccgagcggtagcgccactggttccggcagccgatgctttagtgttggattccaccaccttaagcattgagcaagtgattgaaaaagcgctacaatacgcgcgccagaaattggctctcgcataagcgaccgaatttgcagtacccccgttgcaatggaatgacagcgggtatgttaaacaaccccatccggcatggagccaggtggacgttaaatataaacctgaagattaaacatgactgaatcttttgctcaactctttgaagagtccttaaaagaaatcgaaacccgcccgggttctatcgttcgtggcgttgttgttgctatcgacaaagacgtagtactggttgacgctggtctgaaatctgagtccgccatcccggctgagcagttcaaaaacgcccagggcgagctggaaatccaggtaggtgacgaagttgacgttgctctggacgcagtagaagacggcttcggtgaaactctgctgtcccgtgagaaagctaaacgtcacgaagcctggatcacgctggaaaaagcttacgaagatgctgaaactgttaccggtgttatcaacggcaaagttaagggcggcttcactgttgagctgaacggtattcgtgcgttcctgccaggttctctggtagacgttcgtccggtgcgtgacactctgcacctggaaggcaaagagcttgaatttaaagtaatcaagctggatcagaagcgcaacaacgttgttgtttctcgtcgtgccgttatcgaatccgaaaacagcgcagagcgcgatcagctgctggaaaacctgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggcctgaaacagctgggcgaagatccgtgggtagctatcgctaaacgttatccggaaggtaccaaactgactggtcgcgtgaccaacctgaccgactacggctgcttcgttgaaatcgaagaaggcgttgaaggcctggtacacgtttccgaaatggactggaccaacaaaaacatccacccgtccaaagttgttaacgttggcgatgtagtggaagttatggttctggatatcgacgaagaacgtcgtcgtatctccctgggtctgaaacagtgcaaagctaacccgtggcagcagttcgcggaaacccacaacaagggcgaccgtgttgaaggtaaaatcaagtctatcactgacttcggtatcttcatcggcttggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatctccctgggcgttaaacagctcgcagaagatccgttcaacaactgggttgctctgaacaagaaaggcgctatcgtaaccggtaaagtaactgcagttgacgctaaaggcgcaaccgtagaactggctgacggcgttgaaggttacctgcgtgcttctgaagcatcccgtgaccgcgttgaagacgctaccctggttctgagcgttggcgacgaagttgaagctaaattcaccggcgttgatcgtaaaaaccgcgcaatcagcctgtctgttcgtgcgaaagacgaagctgacgagaaagatgcaatcgcaactgttaacaaacaggaagatgcaaacttctccaacaacgcaatggctgaagctttcaaagcagctaaaggcgagtaattctctgactcttcgggatttttattccgaagtttgttgagtttacttgacagattgcaggtttcgtcctgtaatcaagcactaagggcggctacggccgcccttaatcaatgcagcaacagcagccgcttaatttgcctttaaggaaccggaggaatcatgaccaagtcagaattgatagaaagacttgccacccagcaatcgcacattcccgccaagacggttgaagatgcagtaaaagagatgctggagcatatggcctcgactcttgcgcagggcgagcgtattgaaatccgcggtttcggcagtttctctttgcactaccgcgcaccacgtaccggacgtaatccgaagactggcgataaagtagaactggaaggaaaatacgttcctcactttaaacctggtaaagaactgcgcgatcgcgccaatatttacggttaagttttttactcaaacttgaacgagagaaaagcacctgtcgggtgcttttttcatttctctaatctggaactggaagctgcctcgcagagttttgaacagttttcaccctttcgttaaattcttctgaatatgcctcggggaacgcaaaattcccaccagacaaccgctcaacaaagttgcacactttccataaacagggaggggtgcatgaaaataacgacagtcggtgtatgcataattagcggaatttttccgttgctgattttgccccaattgcctgggacattaacccttgcgtttctgactctcttcgcctgcgtactggcatttatccctgttaaaaccgtccgttatatcgcgctgacgttgctgtttttcgtttggggcatattatcagcaaagcaaattttgtgggcaggagaaaccttaactggcgcgacgcaggatgcaattgttgagatcactgcaactgacggcatgaccactcattacggtcaaattactcatctacaaggtcgacgtatattccctgcgtcaggtctcgtgatgtatggcgaatatcttccgcaagcggtttgtgctggacaacaatggtcaatgaaactcaaagttcgtgcagttcatggccaacttaatgatggcggctttgatagccagcgttatgccattgcccagcatcagccgctcaccggccgttttctgcaggcaagtgtcattgaaccgaattgtagcctgcgtgcacagtatctggcgtcactacaaacaacgctgcaaccctatccgtggaatgcggttattcttggtttaggtatgggggaacggttatccgtccccaaagaaatcaaaaatatcatgcgcgatactggaacggcgcatttaatggcgatatcgggattgcacatcgcttttgcggcgttgctggctgccggactcattcgcagtggacaaatttttctgcctgggcgctggatccactggcaaataccattaattggcggaatctgctgtgctgctttttatgcctggttgacgggaatgcaacctcctgcattgcgtaccatggtggcgcttgctacgtggggaatgcttaagttaagtgggcgacagtggagtggctgggatgtatggatatgttgtctggcggcaattttgctgatggatcctgttgccattctctcgcaaagtttatggctctctgccgctgcggtcgcggcattgatattttggtatcagtggtttccctgtcctgagtggcaactgccgccggtattgcgtgcagttgtttccctcatccatctgcaactgggaatcacacttctgcttatgcccgtgcaaatcgtcatatttcatggcattagtctgacctcgtttattgcaaatctattagcaattcccttggtgacatttatcacggttccgttgatcctcgccgcgatggttgtgcatttaagcgggccgttaatcctggagcaagggttatggtttcttgccgaccggtctttggctttacttttctgggggttaaagagtttgccggaagggtggatcaacattgctgaatgttggcaatggctatcattttccccatggttcttactggtggtatggcgattaaacgcctggcgaacgttgccagcaatgtgtgtggctggaggcttgctgatgtgctggccgctgtggcaaaaacctcgacctgacgagtggcagctgtacatgcttgatgtcgggcaagggctggcaatggtgatagccagaaacggcaaagcgattctctatgacacaggactggcctggcctgaaggggatagtgggcaacaactgattatcccctggctccactggcataatcttgaaccggaaggcgttattctgagccatgaacatctggatcaccggggagggctggattcaatattgcatatatggccgatgttatggatcagaagtccgttaaactgggaacatcatcagccctgtgtgcgtggcgaagcgtggcaatggcaaggattgcgtttcagcgcgcactggcctttacaaggtagcaacgataaaggaaataaccattcctgtgtggttaaggttgatgacgggacgaatagcattcttctaaccggtgatattgaagccccagctgaacaaaagatgctaagccgttactggcagcaagtgcaggcaacattgcttcaggtacctcaccatggcagtaatacctcatcatcgttgccattaattcagcgagtgaatggaaaagtggcactcgcatcggcatcgcgctataacgcatggcgactgccctctaacaaagttaagcatcgctatcaactgcaaggatatcaatggattgatactccacatcaaggtcaaacaacggtcaatttttcagcgcaaggctggcggattagcagcctcagggagcaaattttacctcgttggtatcatcagtggtttggcgtgccagtggataacgggtagaatatgcggctatttcaacaaatgctggttttttgaatgcataacgacaaagatctctctacgtggcagacattccgccgactgtggccaaccattgcgcctttcaaagcgggtctgatcgtggcgggcgtagcgttaatcctcaacgcagccagcgataccttcatgttatcgctccttaagccacttcttgatgatggctttggtaaaacagatcgctccgtgctggtgtggatgccgctggtggtgatcgggctgatgattttacgtggtatcaccagctatgtctccagctactgtatctcctgggtatcaggaaaggtggtaatgaccatgcgtcgccgcctgtttggtcacatgatgggaatgccagtttcattctttgacaaacagtcaacgggtacgctgttgtcacgtattacctacgattccgaacaggttgcttcttcttcttccggcgcactgattactgttgtgcgtgaaggtgcgtcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgcagaacaaatgctgaagggccacaaagaagtattgattttcggtggtcaggaagtggaaacgaaacgctttgataaagtcagcaaccgaatgcgtcttcaggggatgaaaatggtttcagcctcttccatctctgatccgatcattcagctgatcgcctctttggcgctggcgtttgttctgtatgcggcgagcttcccaagtgtcatggatagcctgactgccggtacgattaccgttgttttctcttcaatgattgcactgatgcgtccgctgaaatcgctgaccaacgttaacgcccagttccagcgcggtatggcggcttgtcagacgctgtttaccattctggacagtgagcaggagaaagatgaaggtaagcgcgtgatcgagcgtgcgactggcgacgtggaattccgcaatgtcacctttacttatccgggacgtgacgtacctgcattgcgtaacatcaacctgaaaattccggcagggaagacggttgctctggttggacgctctggttcgggtaaatcaaccatcgccagcctgatcacgcgtttttacgatattgatgaaggcgaaatcctgatggatggtcacgatctgcgcgagtataccctggcgtcgttacgtaaccaggttgctctggtgtcgcagaatgtccatctgtttaacgatacggttgctaacaacattgcttacgcacggactgaacagtacagccgtgagcaaattgaagaagcggcgcgtatggcctacgccatggacttcatcaataagatggataacggtctcgatacagtgattggtgaaaacggcgtgctgctctctggcggtcagcgtcagcgtattgctatcgctcgagccttgttgcgtgatagcccgattctgattctggacgaagctacctcggctctggataccgaatccgaacgtgcgattcaggcggcactggatgagttgcagaaaaaccgtacctctctggtgattgcccaccgcttgtctaccattgaaaaggcagacgaaatcgtggtcgtcgaggatggtgtcattgtggaacgcggtacgcataacgatttgcttgagcaccgcggcgtttacgcgcaacttcacaaaatgcagtttggccaatgatcgaaaaaatctggtctggtgaatcccctttgtggcggctattgctgccactctcctggttgtatggcctggtgagtggcgcgatccgtctttgctataaactaaaactgaagcgcgcctggcgtgcccccgtaccggttgtcgtggttggtaatctcaccgcaggcggcaacggaaaaaccccggtcgttgtctggctggtggaacagttgcaacagcgcggtattcgcgtgggggtcgtatcgcggggatatggtggtaaggctgaatcttatccgctgttattgtcggcagataccacaacagcacaggcgggtgatgaacctgtgttgatttatcaacgcactgatgcgcctgttgcggtttctcccgttcgttctgatgcggtaaaagccattctggcgcaacaccctgatgtgcagatcatcgtaaccgacgacggtttacagcattaccgtctggcgcgtgatgtggaaattgtcgttattgatggtgtgcgtcgctttggcaatggctggtggttgccggcggggccaatgcgtgagcgagcggggcgcttaaagtcggttgatgcggtaatcgtcaacggcggtgtccctcgcagcggtgaaatccccatgcatctgctgccgggtcaggcggtgaatttacgtaccggtacgcgttgtgacgttgctcagcttgaacatgtagtggcgatggcggggattgggcatccgccgcgcttttttgccacgctgaagatgtgtggcgtacaaccggaaaaatgtgtaccgctggccgatcatcagtctttgaaccatgcggatgtcagtgcgttggtaagcgccgggcaaacgctggtaatgactgaaaaagatgcggtgaaatgccgggcctttgcagaagaaaattggtggtatttgcctgtagacgcacagctttcaggtgatgaaccagcgaaactgcttacgcaactaaccttgctggcttctggcaactagttacgccgcggcagcgttcgattgatggagtcatgaatgtcgctgccgcacctctcccttgctgatgcgcgtaatcttcaccttgccgcacaaggcctgttaaacaaaccccgccgtcgagcgtcgttggaggatattccggcaacgatctcccgcatgtccttgctgcaaatcgataccatcaatattgttgcccgtagtccatatctggtgcttttcagtcgtctgggaaattatcctgcccagtggctggatgagtctctggcgcgtggcgaattaatggaatactgggcgcatgaagcctgctttatgccgcgtagcgactttcgtcttattcgccaccgcatgctggcacctgaaaaaatgggctggaaatacaaagacgcctggatgcaggaacatgaggcggaaattgcacagttaattcagcatattcatgataaggggccggtacgttcagccgattttgagcatcctcgtaaaggtgcaagcggctggtgggaatggaagccgcataaacggcatctggaaggtttatttactgccggaaaggtgatggtgattgaacggcgcaacttccagcgcgtttatgatttaacccaccgtgtcatgcctgactgggatgatgagcgcgatctcgtttcgcaaacagaagcagaaatcatcatgctggataacagtgcgcgtagcctgggaatattccgcgaacagtggctggcagattactatcggctgaaacgtccggcactggcggcgtggcgcgaagcgagggctgaacagcagcaaatcattgctgtgcatgttgaaaaattgggcaatctttggctgcatgatgatttgctgccgctactcgagcgagcgctggccggaaagctcactgcaacgcacagcgcggtactttcgccttttgatcctgttgtctgggatcgcaaacgcgcagagcagctttttgattttagctaccggctggagtgctataccccagcgccgaaacgccagtatggctattttgttctgccgttattacatcgtgggcaattagttgggcgaatggatgccaaaatgcatcgccagacaggcatccttgaagttatctctctgtggttacaggaaggtattaaaccaacgacaacgctgcaaaaagggctacgtcaggcgattactgatttcgctaactggcagcaggcaacgcgggtgacattaggatgctgcccgcaaggcctctttactgattgccgcaccggctgggaaatagaccccgtcgcataaatgattatgataagatttatgcattcataacccgatccatctggaggaactatggatcatcgtctgcttgaaatcattgcctgcccggtttgcaacggaaaactttggtataaccaggaaaaacaagagcttatttgcaaactggacaacctcgctttcccgctgcgtgatggcattccagtgttgctggaaacggaagcccgcgtgctgactgctgatgagagtaaatcatgagttttgtggtcattattcccgcgcgctacgcgtccacgcgtctgcccggtaaaccattggttgatattaacggcaaacccatgattgttcatgttcttgaacgcgcgcgtgaatcaggtgccgagcgcatcatcgtggcaaccgatcatgaggatgttgcccgcgccgttgaagccgctggcggtgaagtatgtatgacgcgcgccgatcatcagtcaggaacagaacgtctggcggaagttgtcgaaaaatgcgcattcagcgacgacacggtgatcgttaatgtgcagggtgatgaaccgatgatccctgcgacaatcattcgtcaggttgctgataacctcgctcagcgtcaggtgggtatggcgactctggcggtgccaatccacaatgcggaagaagcgtttaacccgaatgcggtgaaagtggttctcgacgctgaagggtatgcactgtacttctctcgcgccaccattccttgggatcgtgatcgttttgcagaaggccttgaaaccgttggcgataacttcctgcgtcatcttggtatttatggctaccgtgcaggctttatccgtcgttacgtcaactggcagccaagtccgttagaacacatcgaaatgttagagcagcttcgtgttctgtggtacggcgaaaaaatccatgttgctgttgctcaggaagttcctggcacaggtgtggatacccctgaagatcttgagcgcgttcgcgctgaaatgcgctaatttcacttcacgacacttcagccaattttgggaggagtgtcgtaccgttacgattttcctcaatttttcttttcaacaattgatctcattcaggtgacatcttttatattggcgctcattatgaaagcagtagcttttatgagggtaatctgaatggaacagctgcgtgccgaattaagccatttactgggcgaaaaactcagtcgtattgagtgcgtcaatgaaaaagcggatacggcgttgtgggctttgtatgacagccagggaaacccaatgccgttaatggcaagaagctttagtacgcccggaaaagcccgacaactggcatggaaaaccaccatgctggcaagaagtgggactgtccgtatgccgactatttatggtgtgatgacgcatgaagaacaccccggccccgatgtcctgctactggagcggatgcgtggtgtttcggtggaggcaccagcccgaacaccagaacgctgggaacaactcaaagaccaaatcgttgaagccttactggcctggcaccgtcaggacagtcgcggttgcgtcggcgcggtcgacaatactcaggaaaatttctggccctcatggtaccggcaacatgttgaagtgctatggaccacgctcaatcagttcaataacaccggtctgacgatgcaggataagcggatcctgtttcgcactcgcgaatgtctcccggcattatttgaaggctttaacgacaattgtgtgctgattcacggtaacttctgtttacgcagcatgttgaaagattcgcgcagcgatcagttactggcgatggtcgggccgggactaatgctttgggcaccgcgagaatacgaactgttccgactaatggataattctctggcggaagatttgctctggagttacctgcaacgcgcgccagtggcggagtcgttcatctggcggcgttggttgtatgtgttatgggatgaagttgcgcaactggttaataccggacgatttagtcggcgcaacttcgatctggcatcaaaatcactcttgccgtggctcgcctgacgaaccttttagccactgccagatacggccaagcgtttcatagccaacacgatcgctatgcatcaaccagaccggagaagggattgcccgttcccacgggttaagcggcgagtcgatggccaactgattcgccggggctggtagcggatttaacccttcctgctgaaaaaagatcatcgcccgcggcagatgtgatgcggaggtcaccagcaggaaaggggcgtcaccaatcgcctgtttcactgctgcagcttcttcttcggtatcttttggcaaatccagggtgataatttgctcgcgcggcacgcccagcgattgcgcaactctggcacctacttccgctgtactcaccgtattggtttttgctacgcctcccgtgaagatcagttttgatcccggattttcgcgccataagcgaataccttcattcaggcgtggcagactgttattgattaaattagagctcggtgcccactgcgggttccaggtataaccacctccgagcaccacgatatagtccactttttgcgaattattccatgtcggataggtgctttcgatgggacgcagcaggcggtcggctaccggttgcaaactcaataacaagagcgccagccacccaatgctaataaaaatcttcccggttttttgaaaacggctaaaccacagcagcgccaggccagcgccaataatcaacaacatcagcggaagtggcagcaacatattgccaatcacttttttcagtgtaaaaagcatcctttctggttccttttttaaccatatagcaagggatcgccagcgatattacaccagacgggttcattctcgccgtggctgtgacaaaatagcgtctttatcagaaaacgtcttagccaaccggtggagaaagcaatgcaggatcgcaattttgatgatattgcggaaaagttttcccgtaacatttacggcaccaccaaagggcagcttcgacaggctattctgtggcaggatctcgatcgcgtgctggcggaaatgggcccgcaaaaactgcgtgtgctggatgctggcggtggagaagggcagaccgcaatcaaaatggccgagcgtgggcatcaggtcattttatgcgatctttctgcgcagatgatcgaccgcgcaaaacaggcggcagaagcaaaaggtgtgagcgacaacatgcaatttatacattgcgccgctcaggatgttgcttcgcatttggaaacgcccgttgatctgatattgttccatgcggtgctcgagtgggtggctgatccccgcagcgtattgcagaccctctggtcagtgttgcgtccaggcggcgtgttgtcgttaatgttctacaatgcgcatggtttgttgatgcataacatggtcgccgggaattttgattacgtgcaggcgggaatgccgaaaaagaaaaaacggacgctttcgccagattatccacgcgacccggcgcaggtttatctgtggctggaagaagctggttggcaaattatgggtaagacaggcgttcgcgtgtttcatgattatctgcgcgagaaacaccagcagcgcgactgctatgaagcattacttgaattagaaacgcgttattgccgtcaggaaccgtatattaccctggggcgttatattcatgtcaccgcgcgcaaaccgcagagcaaggataaagtatgagtgaattttcccagacagtccccgaactggttgcctgggccagaaaaaatgacttctccatctcgctgccggtagaccgactctcttttctgctggcggttgccacgctgaacggcgagcgtctggatggtgagatgagtgaaggcgagctggtggatgcattccgccatgtgagtgatgcgtttgagcaaaccagcgaaaccatcggcgtgcgcgccaataacgcgatcaacgacatggtgcgtcaacgtctgctgaaccgctttaccagcgagcaggcggaagggaacgcaatttaccgtctgacgccgctcggcatcggcattactgactactacatccgtcagcgcgagttttctacgctgcgtctttctatgcagttgtcgattgtggcgggtgagctcaaacgcgcagcagatgccgccgaagagggcggtgatgaatttcactggcaccgtaatgtctatgcgccactgaaatattcggtagcagaaattttcgacagtatcgacctgacgcaacgtctgatggacgaacagcagcagcaggtgaaggacgatatcgcccagttgctgaacaaagactggcgggcggcgatttccagctgtgaattgttgctttcggaaacttccggaacgctgcgtgaattgcaggatacgctggaagcggcaggcgacaaattgcaggctaatctgttgcgcattcaggatgcgacgatgacccatgacgatctgcatttcgtcgatcgtctggtgttcgatctgcagagcaaactcgatcgtattatcagttggggccagcaatccatcgacttgtggattggctacgaccgccacgtacacaaatttattcgtaccgcgatcgatatggataaaaaccgcgtctttgctcagcggttacgtcagtcggtacaaacctattttgatgagccgtgggcgctaacttatgccaatgccgatcgtctgctggatatgcgtgacgaagagatggcactgcgcgatgaagaagtgactggggaacttcctgaggatctggaatacgaagagtttaacgagatccgcgaacagctggcggcgatcatcgaagaacaacttgccgtgtacaaaaccagacaagtgccgctggatcttggtctggtggtacgcgaatatctgtcacagtatccgcgtgcacgtcactttgacgttgcgcgtattgttattgatcaggcggtacgtcttggcgtagcgcaagcagatttcaccggactgccagcgaaatggcagccgattaatgattacggagccaaggtacaggcgcatgtcatcgacaaatattgaacaagtgatgccggttaagctggcgcaggcgctggcgaatccgttatttccggcgctggacagcgccttacgttcaggacgccatattggcctcgacgaactggataatcatgcattcctgatggattttcaggaatatctggaagagttttacgcgcgttataacgttgagcttattcgcgcaccagaagggttcttctatttacgcccacgttccaccacgctgatccctcgttccgtcttgtcggaactggatatgatggtcgggaaaatcctctgttatctctatctcagcccggaacggctggcgaatgaggggattttcacccagcaggaactgtacgacgaactgctcaccctggccgatgaagcaaaactgctgaaactggtgaacaaccgttcaaccggttcagacgttgaccgtcagaagttgcaggagaaagtacgttcttcgctcaaccgtctgcgtcgtttaggcatggtgtggtttatgggccacgacagcagcaagtttcgcattaccgaatcggtgttccgcttcggagccgatgtgcgtgctggcgacgatccccgtgaagcacagcgtcgcctgattcgtgatggcgaagcaatgccgattgaaaatcatctgcaactcaacgatgaaaccgaagagaatcagccagatagcggagaggaagaataatgattgaacgcggtaaatttcgctcactgacgctgattaactggaacggcttttttgcccgaacttttgaccttgacgagctggtcacgacgctttctggcggtaacggggcgggtaaatccaccaccatggcggcgttcgttacggcgctgatccccgacctgaccctgctgcatttccgtaacactacggaagccggggccaccagcggttcgcgcgataaaggtctgcacggtaagctgaaagcgggtgtctgttattcgatgctcgacaccattaactcgcgccaccagcgcgtggtggtcggtgtgcgtctgcaacaggttgccggacgcgatcgtaaagtggatatcaagccgtttgccattcagggactgccgatgtcggtgcagccgacacagctggtgaccgaaaccctgaacgaacgccaggcgcgcgtgctgccgcttaacgagctgaaagacaagctcgaggcgatggaaggcgtgcagtttaaacagttcaactccattactgattaccactcgctgatgttcgatctgggcatcatcgcgcgtcgtctgcgctccgcatctgaccgtagcaaattctatcgtctgatcgaagcttcgctgtatggcgggatctccagtgccattacccgttctctgcgcgactacctgttgccagaaaacagcggcgtgcgtaaagcgttccaggacatggaagcggcgctgcgtgaaaaccgtatgacgctggaagcgattcgtgtcacccagtcggaccgcgacctgtttaagcatctgatcagcgaagccaccaactacgtggcggcggactacatgcgtcacgccaacgagcgccgtgtccatctcgacaaagccctggagtttcgtcgcgagctacatacttcgcgtcagcaactggcggctgagcagtacaaacacgtcgatatggcgcgtgagctggcagagcacaacggtgccgaaggcgatctggaagcggattatcaggcggccagtgatcacctgaacctggtgcaaaccgcactgcgtcagcaggagaagatcgaacgctacgaagcggatctcgatgagctgcagatccgtctggaagagcaaaatgaagtggtggcagaagccatcgaacgccagcaagagaatgaggctcgtgcggaagctgccgaactggaagtggacgagctgaaaagccagcttgctgactaccagcaggcgctggacgtccagcaaacgcgcgcgatccagtataaccaggcgattgctgcgcttaatcgtgccaaagaactgtgccatctgccggacttaaccgccgactgcgccgccgaatggctggaaaccttccaggcgaaagagctggaagcgactgaaaaaatgctctctcttgagcagaaaatgagcatggcgcaaaccgcgcacagccagtttgagcaggcttatcagctggtggtggcaatcaacggcccactggcgcgtaacgaggcgtgggatgtcgctcgcgaactattgcgcgaaggggtcgatcagcgtcacctggcagagcaggttcagccgctgcggatgcgattaagcgaactggaacagcgtctacgcgagcagcaagaagctgagcgtctgctggcagatttctgcaaacgtcagggcaagaattttgatatcgacgaactggaagccctgcatcaggaactggaagcacgcattgcctctctttccgatagcgtgtctaacgcccgtgaagagcgcatggcactgcgccaggagcaggaacagctgcagtctcgcattcagagtttgatgcagcgtgcgccggtttggctggcagcgcaaaacagtctcaaccagttgagcgaacagtgcggcgaagagtttacctccagccaggacgtcaccgaatatctgcaacagttgctggagcgtgagcgagaggcgattgttgaacgcgatgaagtgggcgcgcgcaaaaacgccgtcgatgaagagatcgaacgtttaagccagcctggcggctctgaagatcagcgtctgaacgcgctggcggagcgttttggtggtgtgctgctgtcagaaatttatgacgacgttagcctggaagatgcgccgtacttctcagcgctgtatggcccgtcacgccacgccatcgtggtgccagatctgtcacaggtaactgaacacctggaaggcttgaccgattgcccggaagatctctatctgatcgaaggagatccgcagtcattcgatgacagcgtgttcagcgttgatgagctggaaaaagcggtagtggtgaaaatcgccgatcgtcagtggcgttattcacgtttcccggaagtgccgctgtttggtcgtgctgcgcgtgaaagccgtattgaaagcctccatgccgagcgtgaagtgctttccgaacgcttcgccacgctctcctttgatgtacagaaaactcagcgtctgcatcaggcgttcagccgctttatcggcagtcatctggcggttgcgtttgagtctgacccggaagcagaaatccgtcaactgaacagccgtcgcgtcgaactggagcgggcgttaagtaatcatgaaaatgataaccagcagcagcgtattcagtttgagcaggcgaaagagggcgttacggcgctgaaccgcattctgccgcgtctcaacctgttggctgatgacagcctggcggatcgcgtcgatgaaatccgcgaacgtctggatgaagcccaggaagccgcgcgttttgttcagcagtttggcaatcaactggcgaaactggaaccgattgtttcggtattgcagagcgacccggaacagttcgaacagttaaaagaagattacgcgtactctcagcagatgcagcgcgatgcccgtcagcaggcgtttgccctgacggaagtggtgcagcgtcgtgcgcactttagctattctgactcggcagaaatgcttagcggtaacagcgatctcaacgaaaaactgcgtgaacgtctggaacaggcggaagcggagcgtacccgcgctcgcgaagcgttgcgcggtcacgcagcgcagttgagtcagtacaaccaggtgctggcttcgctgaaaagttcttacgacaccaaaaaagagctactcaacgatctgcaacgtgaattgcaggatatcggcgtgcgtgctgatagcggggcagaagagcgggcgcgtattcgccgtgacgagctgcatgcgcaactgagcaataaccgttcacgccgcaatcaactggaaaaagcgcttaccttctgcgaagcggagatggacaacctgacccgcaaactgcgcaagctggagcgggattactttgagatgcgcgagcaggtagtgaccgccaaagcgggctggtgtgcggtgatgcgcatggtgaaagataacggcgttgagcgccgcttacaccgtcgtgagctggcttatctctccgctgatgatttgcgttccatgtcggataaggcgttaggtgcgctgcgtctggcggtggcggataacgaacatctgcgcgacgtgctgcgcatgtcggaagatccgaaacgtccggagcgtaaaattcagttcttcgtggcggtttatcagcatctgcgtgaacgtattcgtcaggatattattcgtaccgatgatccggtggaagctatcgaacagatggagattgaacttagccgtctgaccgaagaattaacctcccgtgaacagaaactggcgatcagttcccgcagcgtggcgaacatcattcgcaaaaccattcagcgcgagcagaaccgtatccgtatgctcaaccaggggttgcagaacgtatcgtttggtcaggtgaacagcgtgcgtctcaacgtgaacgtgcgtgaaacgcacgccatgctactggatgtgctctctgaacagcacgagcagcatcaggatctgtttaacagcaaccgtttgaccttctcggaagcgctggcgaaactgtatcaacgtcttaacccgcagattgatatggggcagcgcacgccgcagaccatcggtgaagaactgctggattaccgcaactatctggaaatggaagttgaggttaaccgtggttccgatggctggctgcgcgcagagtctggtgcattgtcgaccggtgaggcgattggtaccggtatgtcgattctggtgatggtggtacaaagctgggaagatgaatctcgccgcctgcgcggtaaagatatctctccttgccgcctgctgttcctcgatgaagcagcgcgactggatgctcgttctatcgccacgctgtttgaattgtgtgagcgtttgcaaatgcaactcatcatcgcagcgccggaaaatatcagcccggagaaaggcaccacctataaactggtgcgtaaagtcttccagaataccgaacacgttcatgtcgtcggcctgcgaggatttgcgccgcaactccctgaaacgcttccaggaactgacgaagcgccttctcaggcgagttaaaattaaggcggcagcaatgccgccttttctttttccgaaaactccgtttctgcactaaaaaagtggcacattacggcgcgcttttctttaaacttctttacattaggttatgtaaaaacgtatcggcgtttatatactgaagataagcctgatgagtaacaggcttgctcgtcatactttcgtgagtattggcgttgtacaggcaagtcgtaaaataacagcctggctattcagagtatgataaaaacagggggcaagggatgttgcttaatatgatgtgtggtcgtcagctgtcggcaatcagtttgtgcctggccgtaacattcgctccactgttcaatgcgcaggccgatgagcctgaagtaatccctggcgacagcccggtggctgtcagtgaacagggcgaggcactgccgcaggcgcaagccacggcaataatggcggggatccagccattgcctgaaggtgcggcagaaaaagcccgcacgcaaatcgaatctcaattacccgcaggttacaagccggtttatcttaaccagcttcaactgttgtatgccgcacgcgatatgcaacccatgtgggaaaaccgtgatgctgttaaagccttccagcaacagctggcagaggtggcgattgccggtttccagccgcagtttaataaatgggtagagttactgaccgatcctggtgttaacgggatggcacgcgacgtggtgctctctgatgcgatgatgggctatctccatttcattgcaaatattccggtcaaaggcactcgctggctatatagcagtaaaccttatgcacttgcaacgccgccgctctcggtgattaaccaatggcagctggcgctggataaaggtcaattgcctacgtttgttgcaggactggcaccgcagcatccgcaatatgcggcgatgcatgaatcgttactggccttactctgtgacaccaaaccgtggccccaactgaccggcaaagcaacgttgcgcccagggcagtggagtaacgacgtaccggcgttgcgcgaaatattgcaacgcacaggcatgttggacggggggccgaaaattactctacctggcgatgacacgccaactgacgcggtagtcagcccatccgctgttactgttgaaacagcagaaactaagccgatggataagcaaacgacgtctcgtagtaaacctgcgcctgccgttcgcgccgcctacgataatgaactggtggaagccgttaaacgttttcaggcatggcaaggattgggggcagatggtgctattggcccggcaacacgtgactggttaaacgtaacgcccgcccagcgtgctggtgtgttggctctcaacatccagcgattgcgcttgctgccaacagagctttctaccgggatcatggttaacattccggcctattcgctggtctactatcagaacggcaatcaggtgctggattcgcgagtcattgtcggtcgccccgatcgcaaaacgccgatgatgagcagtgcccttaacaacgtagtggtaaacccgccgtggaacgtacctccaactctggcacgcaaagatattctgccaaaagtgcgcaacgatccgggatatctcgaaagccatggctatacggtgatgcgcggctggaacagcagagaagcgattgacccatggcaggttgactggtctacaatcacggcctcgaatttaccgttccgcttccagcaggctccaggcccacggaactcgctggggcgctataaattcaatatgccgagttcagaggccatttatttgcatgacacgccgaaccacaatctgttcaagcgtgatacacgcgcattgagctcaggctgtgtacgagtgaataaagcttccgatctggcgaatatgctgttgcaggatgcaggctggaatgacaaacgtatttctgatgcgctgaagcagggtgatacacgttacgtcaatattcggcagtcgattccggtgaatctctactacctgacggcctttgttggtgcagatggtcgtacccagtatcgtacagatatttacaattatgatctgcctgcgcgatccagctcgcaaatcgtatcgaaagcggaacaattaatcaggtaaatgaagtagttcggggaaatcagttgtcgtaataattagcatgattgggggcgattctctgcagcccccgtcactgctggggttgagtcatcttgacgtctgctttacgggcggttaaggtgcctcttgtgcgccagaagtgcatataaacgataacattgacctgtagacttgattatcatggacaaattcgacgctaatcgccgcaaattgctggcgcttggtggcgttgcactcggtgccgccatcctgccgacccctgcgtttgcaacactctctaccccacgcccgcgcattttgacactcaataatcttcataccggagagtcaatcaaagcggagtttttcgatggcagaggctatattcaggaagaattggcaaaacttaaccattttttccgcgattaccgcgcgaacaaaataaagtccatcgacccaggattattcgaccagttgtatcgcctgcaagggttgttaggcacgcgcaaaccggtgcaactcatttccggttatcgttctattgataccaacaatgaactacgcgcccgcagccgtggagtagcgaagaaaagctatcacactaaaggccaggcgatggatttccatattgaaggtatcgcgttaagcaatattcgcaaagccgcgttatctatgcgcgcaggtggtgtaggatattatccacgtagtaactttgtgcatattgataccgggccagcacggcactggtagtaattgcttaacgaaacaggggcagtatgaactatcgtattattccggtcaccgcattctcccagaactgttcattaatctggtgtgaacaaacccgtctggccgcactggtcgatcctggcggcgatgcggaaaaaatcaaacaggaagttgatgacagcggcctgacactgatgcagatcctgctgacgcatggtcatctggaccacgttggcgcagcggcggaactggcgcaacattacggcgtgccggttttcggcccggaaaaagaagatgagttctggctgcaaggcttgcctgcgcaaagtcgtatgtttggtctggaagagtgccagccgctgacgccagatcgttggctgaacgaaggcgataccatcagcatagggaatgtgactttacaggtgttacattgccctgggcatacgccgggtcatgtcgtgttttttgatgatcgggcaaagctgctgatttctggcgatgttattttcaaaggcggagtagggcgcagtgacttcccgcgtggcgatcataatcaactgatttcttcaatcaaagataaattgctgccactgggggatgacgtgatatttattccgggtcacggaccattatccacacttggttatgaacgcctgcataatcccttcctgcaagacgaaatgcccgtctggtaaggcacataaaaaagcccgcttttaatgctggcctggatttctggcaaagtgcgctttgtttatgccggatgcggcacgagcgccttatccggcctacaaaatcgtgcaaattcaaaatattgcaggggacgcgtaggcctgataagcgtagcgcatcaggcaatgttgcgtttgtcatcagtctcagcccgcttttcagcgggcttcattgtttttaatgcttacagcactgccacaatcgcttcgcacagcggagccatgttatctggtgtcatcccggccacatttacgcgaccagaagcaaccgcatatacgccaaactcttcgcgcagacgcagcacttgttcttttgtcaggccactgaaggagaacatgccgttctgtttgatgataaagctgaagtcgcggtttgcgcctttttcctgcagcgtattgacgaacaactgacgcatacgctgaatacgctggcgcatatcagtcagctcttgttcccaaatcgcacgtaacgcatcgttgctcaggatggtggcaacaacagaagcgccgtgtgctggtgggttagagtagttagcgcgaatcgccgctttcatttggctgaatgcgcgatcaacggtttcactgtcggcagcaaccagagtacaagcgccaacacgctcgttgtacaggccaaagtttttagagtaggaactggcaacaatcagctctttatgcatagccgcgaaagcgcgcagtccttcagcatcttcttccagaccacgggcaaaaccctggtaagcgaagtcaaacagcggtaaccagcctttctcaacggagagttgtgccagtgtttgccattgttccagcgtagggtcgataccggttgggttatggcagcagccatggaacagcactacgtcgccagcctgagcttcattcaggctgttaatcagtgcatcgaagtcaagagtgtgattttccgcatcataataagcgtattcacgaacttccagacctgcagagttaaagacgctcttatggttcggccagcttgggttgctcacccacacacgcttaacgctggtattttttgccaggaaatcggcagccacgcgtagtgcgccagtgccccccggagtctgtgccgtgcgagcacgtttgtcattgatcagggcgctacctttaccaaacagcagttcctgagtgcagcgaccaaattcagggatgccgtcaatgccgaggtaatttttggtggtttcattttcgagcagatactgttcagcctttttcacgctggtcagtaccggggttttgcccgtctcatctttatagacaccaatcccgaggttaattttgccgggacgttcatcggcacgaaacagatcggccaggcccagaatcgggtcggcaggagcggcggtaatgttctcaaacatgacgaggttccattatggttacagaagggaagtccgctatcagggtaacgggagatttacaaaattccaactattactgatgaaaacgcaggctgtttttgcaagacgtgagattgctctggaaggtataaaaaaaacaggaccaaagtcctgttttttcggcatttaacaaagaggtgtgctattagaactggtaaacgatacccacagcaacggtgtcgtctgaacctacgcccagtttgttgtcagaatcgatctggttgatgatgtagtcaacataggtggacatgtttttgttgaagtagtaggttgcgcccacttcaaagtagttcaccagatcaacatcaccgataccttctacgtctttcgctttagatttggtgtaagcgatggacggacgcagaccgaaatcgaactggtattgcgcaactaacagaacgtcttgcgttttgttggcgaagccgctggtgtttgtaaatttattagtgatcggcgtagcgttacgggtttcaccgtagttcgctgccaggtagatgttgttcgcgtcgtacttcagaccagtagcccactgttcagcttttttaccgttgccaagaggttgagcttcttgcaggttggtacggtcagctgcaccataagcaccaacgataccaaagccttcgtattcgtagctgatagaaccgccaacaccgtcgccgttagaacggcgtgcagtgtcacgctcgtttttacccaggtactgaacagcgaagttcaggccatcaaccagaccaaagaagttggagttacgataggtagcaacgccgccaacacgaccaacgaagaagtcatcgctgtatgcagtatcaccaccaaattctggcagcatatcggtgtaacccagtgcatcataaaccacaccgtagttacggccgtaatcgaaagaaccaacgtcagcgtatttaagacccgcgaatgccagacgcgttttgttaccagtttgagcgtcagcgccttcagagttgttaccctggaagttatattcccactgaccataaccggtcagatcggaattgatttgagtttcccctttaaaaccaagacgggcataggtcatgtcgccattgccaccgtaactgttttcaccgttacccttggaaaaataatgcagaccaacagctttaccgtacagatctactttgttgccatctttgttatagatttctgcagcgtttgcagtacctgctactaacagagcagggacgatcactgccagaatattgcgcttcatcattatttattaccctcatggttttttttatgacacctgccactgccgtcaataagttctgtcaataaaaatttacggaactattgatgagagtttggtgtctttatgtgtctgcaggcatctttccattcaaactaacgtttcgctaccgtgaaagtgctacaaagataaagatttggtttcaaaaagaaaaaatatgtaaccaaaagtaaaatttaaggaactttgtgaacaccgtcatatttccatagagacgtgatgatatttacagcaattttaatctatttatatgatttccttatatttaaattaactaaacggaaattttgtttctgatggaaactttatcgacctggcacaaaatcttctttcagacatccagaatgccaaaaaatagtatgaaaattgtgctattagctaagaaaaaactaatccgcaataagaatgcggattagtttttgcgcgtaaatgttgcaatgtaatattccgtaacaggatgatcgttatggcggggttgcaaatagattgcttgacttaacaaacagataacttgacagaaaagataaaaaaagagccagcgggcgctggctcttgaagacgctaaattagaagctggcgttacgcggagtacgtgggaacggaatcacatcacgtacgttttgcacgccagttacgtaagcaatcagacgttcaaaaccaagaccgaaacctgaatgcggaacagtaccgtagcgacgcagatcgcgataccaccagtaatcttctttattcaggcccatttccagcatacgctcgtccagcacgtccagacgttcttcacgctgggagccaccaatgatctcaccgatgcccggagccagaacgtccatagccgcaacggttttaccgtcttcgttaaggcgcatatagaacgctttaatatctttcggatagtttttaaccactaccggtgctttaaagtgttcttccgccagataacgctcatgctcagaagagagatcgactccccagtaaaccgggttttcaaacttcctgccgcagttttcgagaatggtcactgcgtcggtataatccacctgcgcaaaatcggcttcaatgaagcgttccagacgtgaaacggcatctttatctacgcgttcagcgaagaatttcatgtcgtcagcgcgttcttcgagaaccgctttgaagacatatttcagcatggcttcagccagacccgcaatatcgttcaggttagcaaacgccacttccggctccagcatccagaattccgccaggtgacggctggtgttggagttttcagcacggaaagtcgggccgaaggtataaattttggacaatgcgcaagcgtaggtttcgccgttcaactggccagatacggtcaggaaagactctttaccaaagaagtctttgtcgaaatccactttgccctgatcgttacgcggcaggttttccagatccagcgtagaaacgcggaacatttcgcctgcaccttcggtatcagatgcggtaatcagtggcgttgaaacccagaagaatccctgctcgttaaagaagcgatgcagcgcctgcgccagcgtatggcgaacgcgcgcgacggcaccaatcaggtttgtgcgcggacgcaggtgagcgacttcacgcagatactcaatgctgtggcgttttgccgccatcgggtaagtgtctggatcttcaacccaaccagcaacttcaaccttgctggcctgaatttcaaattgttgcccctggcccggcgacgccacgactttacccgtcacaatgaccgagcagccggtggtcagacgcaggacgtcttcattgtaattgggcagagaattattgatgacagcctgtacaggatcaaagcaggaaccgtcataaacggcgaggaaggagatgccagcttttgaatctcggcgggtacgtacccatccgcgcacggtgacttcgctgtcaacggctacacggccctggagtacgtcggctacaggcacaacgctcataatattctctctgttaatagtcggaaaaaataaacacttgtccacccgtaaatggggggatacctatgttacctggcatctgcaatcagacaagcagaattcgcaaatgcagcgaaagatttcggaattaaaggtaaaaaaagggagccgattagctccctgatgatattaactggcttttttaatatgcggaaggtcgaacgctttgcgcagcgcccgaacaaacgctttatcatggcagatagttttgccagggctgtcagaaagtttcgccaccggtttaccgttacactctaccaacttaatgacaatattcaggggttttacctgggggatatcgcaggtcaggcgagtcccaataccaaaacttaattgcacgcgggaagagaagtggcggtatagctcaaccgctttgcgtaaatccagattgtcagagaaaaccagcgttttactctgtggatcaattcccagcttttcataatgtgcaatggctttttcaccccattcaaccgggtcgccagagtcatgacgcaggccctgataccgactagcgaactcgacaccgaaatcacgcaggaaagcatccatagtgatgcagtcggttaatgcaatgccaagttggtcgggatactcttccagccaggcagcaagtgcagctcgctggctgttggctagatccgggctgatttgctgatgtgcctggaaccattcgtgtgcctgtgttcccatcggcgtgagggaaagccgacgcgccagatcgtagttgctggtgcccacaaaccaggattcctgttgcagacgcttaacgatggtttcttgtacttcgcgagaaaaacggcgacgggtgccaaaatccatcagatggaagcgcgacatatcaagaccggcggttaacgccgagaagtcgactaatttgctttccagcgtgtcgagggcttgcgcaacgtcggcctgcggtgagcgatagcgatgtaccatttcactgataaccgccagcaaaggaacttcccagaggatgacttcacgccacgggccgcttaaacgaatatccagcttgccattatcgttggacacggtgacttgttccgggttaaagcggaactcgcgtaaccagttaagatagtcggccttaaagaaaggcagggcagaaagccactgatattcatcatcctgcaggcgcaggtgctgcatcgcctgaacctgttcacgaatagcatcggcataaatacccagcagatcgtcacctcggcaacgaaactccgccgcgacatgcacatcgtaatagtgatgaaacacggcttgctgcatatgcaacttataagcatctgtatccagcaacgagtgcagaacaggagaagcgaattgtgtcataggtgcgcagtagcgtcctcgtacaggagcgtttagtacaataaacatcttcaggaactgctggagtataccttgtttcgcaatttattgaaccccgatcacaccatatgccacctttctggtcgatggcattacgcggtgtatgttataaaaatgtagcaataaaggcgtttgtacctgaaaagatgaagattctgcatagcgcgatttacgcaacaggaatagactgaacaccagactctataaaagatgctaaaggttatttatgactcaacagccacaagccaaataccgtcacgattatcgtgcgccggattaccagattactgatattgacttgacctttgacctcgacgcgcaaaagacggtcgttaccgcggtcagccaggctgtccgtcatggtgcatcagatgctccccttcgtctcaacggcgaagacctcaaactggtttctgttcatattaatgatgagccgtggaccgcctggaaagaagaagagggcgcactggttatcagtaatttgccggagcgttttacgcttaagatcattaatgaaataagcccggcggcgaataccgcgctggaagggctttatcagtcaggcgatgcgctttgcacccagtgtgaagccgaaggtttccgccatattacgtattatctcgaccgcccggacgtgctggcgcgttttaccaccaaaattattgccgataaaatcaaatatcccttcctgctttccaatggtaaccgcgttgcgcaaggcgaactggaaaacggacgccattgggtacagtggcaggacccgttcccgaaaccgtgctacctgtttgcgctggtggcaggcgactttgatgtactgcgcgatacctttaccacgcgttctggtcgcgaagtagcactggagctgtacgtcgatcgcggcaaccttgatcgcgcgccgtgggcgatgacctcgctgaaaaactccatgaaatgggatgaagaacgctttggcctggagtatgacctcgacatctatatgatcgtcgcggtggatttcttcaatatgggcgcaatggagaataaggggctgaatatctttaactccaaatatgtgctggcccgcaccgacaccgccaccgacaaagattacctcgatattgaacgcgttatcggccatgaatatttccataactggaccggtaaccgagtgacctgtcgcgactggttccagctcagcctgaaagaaggtttaaccgtcttccgcgatcaggagttcagctctgaccttggttcccgcgcagttaaccgcatcaataatgtacgcaccatgcgcggattgcagtttgcagaagacgccagcccgatggcgcacccgatccgcccggatatggtcattgagatgaacaacttctacaccctgaccgtttacgagaagggcgcggaagtgattcgcatgatccacaccctgcttggcgaagaaaacttccagaaagggatgcagctttatttcgagcgtcatgatggtagtgcagcgacctgtgacgactttgtgcaggcgatggaagatgcgtcgaatgtcgatctctcccatttccgccgttggtacagccagtccggtacaccgattgtgaccgtcaaagacgactacaatccggaaaccgagcagtacaccctgaccatcagccagcgcacgccagccacgccggatcaggcagaaaaacagccgctgcatattccgtttgccatcgaactgtatgataacgaaggcaaagtgatcccgttgcagaaaggcggtcatccggtgaattccgtgctgaacgtcactcaggcggaacagacctttgtctttgataatgtctacttccagccggtgcctgcgctgctgtgcgaattctctgcgccagtgaaactggaatataagtggagcgatcagcaactgaccttcctgatgcgtcatgcgcgtaatgatttctcccgctgggatgcggcgcaaagtttgctggcaacctacatcaagctgaacgtcgcgcgtcatcagcaaggtcagccgctgtctctgccggtgcatgtggctgatgctttccgcgcggtactgcttgatgagaagattgatccagcgctggcggcagaaatcctgacgctgccttctgtcaatgaaatggctgaattgttcgatatcatcgacccgattgctattgccgaagtacgcgaagcactcactcgtactctggcgactgaactggcggatgagctactggctatttacaacgcgaattaccagagcgagtaccgtgttgagcatgaagatattgcaaaacgcactctgcgtaatgcctgcctgcgtttcctcgcttttggtgaaacgcatctggctgatgtgctggtgagcaagcagttccacgaagcaaacaatatgactgatgcgctggcggcgctttctgcggcggttgccgcacagctgccttgccgtgacgcgctgatgcaggagtacgacgacaagtggcatcagaacggtctggtgatggataaatggtttatcctgcaagccaccagcccggcggcgaatgtgctggagacggtgcgcggcctgttgcagcatcgctcatttaccatgagcaacccgaaccgtattcgttcgttgattggcgcgtttgcgggcagcaatccggcagcgttccatgccgaagatggcagcggttacctgttcctggtggaaatgcttaccgacctcaacagccgtaacccgcaggtggcttcacgtctgattgaaccgctgattcgcctgaaacgttacgatgccaaacgtcaggagaaaatgcgcgcggcgctggaacagttgaaagggctggaaaatctctctggcgatctgtacgagaagataactaaagcactggcttgataaataaccgaatggcggcaatagcgccgccattcggggaatttacccctgttttctcaggcgagtttcagattcaccacgttgcatcacccgttgcaacacctccgcttccagctccgctaatcgcaccgaccctaatcgacgcggacgggggatatccactgtcaaatccagaccaatttttccctcttcaattaacagcacccggtcagccatcgctaccgcttcgctcacatcatgcgtcaccaacagtacggtaaagccgtgctcctgccaaagtgacacaatcaaatcctgcatctcgagtcgcgttaaggcgtccagcgccccgagcggttcatcaagcaacaataatcccggtcgatgaatcaacgctcttgccagcgccactcgctgtttctgcccgccagaaagtgcggcaggccattcccctgcgcgattctccagtcctaccgcagccaacgctcgacgtgcggcatcgcgccactggcctttaaggcctaacccaacgttatcaatcaccgatttccacggtagcagacgcgcatcctgaaacatcattcgcgtgtcttcctgaatttcagccagcggtgtggtgcccgctaacacatcgcctgcggttggcgtttccagacctgccagcaggcgcagcagggtacttttgccaccaccgctgcggcccaccaccgccacaaactgacctgccggaatatgtaaatccagttggttcaggacgatattttccgcgtaatgtttgcttactgcattgagcaacaatggcgtgccctggttcagacgagcagtattcataccgtggcctccttcaaatgataagccgggttccagcgcaaccagaggcgctctaacagctgcgcgctgacgtcagccagtttgccgagcagggcgtaaagaataatagcgactaccaccacgtccgtttgcaaaaactcccgcgcattcatcgccagataaccaatgcctgaattggcagaaatggtttcggcaacaatcagcgtcagccacatcaggcccaacgcaaaacgcacgccgaccataattgagggcagggcaccaggcaggatcacatggataaacagcggtatgccggataatccatagctacgcgccatctccaccaacccgcgatcgatattacggatgccatgccaggtgttgatataaatggggaatagcgtaccgagcgccaccagaaagatttttgcggattcatcaatgccaaaccacaaaatcaccagcgggatcagcgccagatgcggcacgttgcgcaacatctgaattgaggtatccagcagccgttctccccagcgagatagcccgctaatcagtcccaaaatcaaccccagcgatccgccaattgaaaagccaatcagcgcccgccaggagctgatcgccagatgctgccacagttcgccgctggcggagagcgtccagaacgccgtcaccactccttccggtgaaggcaaaatacgcgtcgacagccagccaaccgaggaggccagttgccacaccgccacgatgcccaccggtaaaaaccagggggcaacgcgcaataaccacttcttcactggcgttgccattatttcttccttagctttgcgcgactttacgggggataaaatcattcgccaccgcttcgccttgcggattcagcggctgcggctggggaatttccgggatggcgacatccagaagcgggaacagcaactcgccaacccgatacgcttcttccagatgcggatagcccgaaagcacaaaactgtcgatgccaagcgcggcatattcgttgattcgcgcagcgaccgtaggaccatcgcccaccagcgccgtcccggcaccgccgcgcactaagccaacgcccgcccataaattggggctgatctccagattgtcgcgcttgccgttatgtaacgccgccattcgctgttgccctacggaatccgtccgggcgaatgcggcctgtgctttggcgatagtttcatcatcaagatgcgagattaaccgctcggcggcctgccacgcttcgtcgttagtttcacgaacaatcacatgcagacgaataccgaaacgaattttgcgtccatgcgcggcagctttcgcccgcacttgttcgattttctctttaaccagttccggcggttcgccccaggtgaggtagagatcaacctgttctgccgccagctcctgggcgacatctgacgatccgccaaagtaaagtggcggatacggctgttgaatcgccgggaagagcagttttgctccgcgcacatgaatatgtttaccgttgaaatcgacggtttctctctgcaataaacgccgccagacctgggtaaattccgccgaggcttcgtagcgctcgctatgatcaaggaacactccgtcgcctgccagctcttgtggatcgctgcctgtgaccaggttaaacaacgcacgtccatttgagagacggtcaagcgtggcggcctggcgggcggcaacggtaggtgaggttacgctgggacgcagggcgacaagaaacttcagccgctgcgtcaccgggatcatcgatgcggcaaccagccacgcatcttcgcaggagcgccccgttggaattagcacaccggtatagccaagacgatccgccgcttgcgcaatttgttgcagataaccgtgatcaaccgggcgtgaaccttcttccgttcccagataatgcccgtcaccgtgggtcggtaaaaaccagaacatattcagactcataattgttttccttccagttgagtgggctgccagatgcgctggcgaatatcgacttttttcggcaccagacgattttcataaaacagatctgccgtttgctgctgtaaggcggcaacctcggcgttaaccggtttgatggtggtaggagggcgatgatctaagtaagaggcaatcaccggtgccggtaagcccatcgtttttgccagtaaagcgatgctttgctcgcgctggctgcgggttaacgcatcggcctcactaaaggttgccagtacgccctgaataaaagcgccgtttttttctgcatagggacgagctgccagataaaacgatccagtttgattgagatcggtgccgtctttcagcacccgcacgccgccctgtaataatgcagcagagtagtagggatcccagatagcccaggcgtcaacgttaccttgctggaacgcggcgcgggcatcagcgggcgtcaggtaagtgggttggatatcggtaaacttaagtccggcctgacgcagtgcacgcagtaaaaggttgtgtgaactggaacctttctgaaaggcaactttgtgacctttaagatcggctacggttttgatcgggctgttttctgccaccagaatcacttcggctttgggcttcggtggctcgacgcccacgtacaccaaatcagccccggcagcctgggcaaagattggcggaatatccccggtactgccgagatcaatactgccaacgtttaacgcttccaacatttgcggacccgcggggaactccacccaggagatttttgattccggatagcgtttttccagtaactggtggctttttgccagcaccataccaatactgcctttctgatagcctatacgtaacgcttcaggcgaggattctgcagcaaccgcaaaagtagagacgctaagcaatcccgccagcgccagtttaatgatgttacgcatgggcattacctcgcagagacagaaggtcaggaacctgaacatcgcggcggtgcaatgcctgccagaaagtttctagcgcggtatcaagacgggtttgcagatttggcgtgaactggggtctgtgatggtaatcaattacttgtgagtcatcggcaaacacgccgtgcaggatctcctgagctttcagtgcgcttaaaactggtttaagggcataatcgaccgccagcagatgggccacggtaccgcccgtcgccagcggtagcaccactttgccttgcaaagcgcgttctggcagcaggtcgagcagggttttcaacgcaccggaataggcggctttatacacaggcgtggcgacaatcagcccatcggcctgttgcagctgttcggtgaaggtcttgagtgccggactatcgaaacgagcataaagtagatcttccggggcgaagttttgcagattccagtgataaacctctacatccaggccatttagtttttcccgcgcatattccagcaaggagctggagcgagaaggaaagcgaggactacccgccagggtgatgacacgcatactctctccttataaccaattgttctttttttgttaacattgataacaattcggtcagtctgtcggagagacaagaaaattccaaatataaattttgtgtatctttttctgaaaataaactaaagaaagggctttatatatcacgcatatttatttattggatagtcattagatgttgaatcaatgaattactcgttcagttaatatttaaatattcatgaaatctataaattaaagatttgtcacttattggatttagtatgcttgatttaaatggcggacaattattgttattattaagtctaatgtcatttaaaggcattatcatatttacgaagagatcaggatgataacgatgaaaaaaagtgtattgacggcgtttataactgtggtatgtgcaacgtccagcgttatggctgctgatgataatgctatcacggatggctcagtaacatttaatggtaaagttattgctccagcttgtaccctggtagctgcgacgaaagattccgtggtgactttgccagatgttagtgccacgaagttgcaaaccaatggtcaggtttctggcgtgcaaattgatgtgccaattgaattaaaagattgtgatactaccgtaacaaaaaatgcaacgttcacctttaatggcactgcggatactactcagattacagcgtttgctaaccaggcctcatctgatgctgctacaaacgtggccctgcaaatgtatatgaatgatggtacaacggccatcacgccagacacagaaaccgggaacattttgttgcaggatggagatcagacgttgacttttaaagttgattatatcgctacggggaaagcgacttcaggtaatgtgaatgcggtaacaaatttccatattaactattattaatagaactcattaattgttttattaattagtacccctccagtgttctggaggggatattcatattttttaagagtgactatttatgaaaacttgcataacaaagggaattgtgaccgtaagtttaacggcaatattactcagctgctcatccgcatgggcggcaggtaaaggcgggattggacttgcagcaacacgtcttgtttattcagaaggtgaagagcaaatttcactgggtgtacgtaacaccagtccggatgttccttatcttattcagtcatgggtgatgaccccagataataaaaaatcagcagactttattattacaccaccgctatttgtgctgaatccggcaaatgagaatctgttacgcattatgtacattggagcgccgttggcgaaagacagagaaacccttttcttcactagcgtacgggcagtcccttcaacaacgaagcggaaagagggaaataccctgaagattgccacacaaagcgtcatcaaacttttctggcgaccaaaaggtttagcgtatcccttaggcgaggctccggcgaaactgcgttgcacttcgtcagctgacatggttacggtcagtaacccaacaccttatttcattaccctgacagacctgaaaataggtggaaaagtagttaaaaatcaaatgatttccccctttgataaataccaattttctctgccaaagggggccaaaaatagcagcgtaacgtatcgaaccatcaatgactacggggcggaaacgccgcaactcaactgtaaatcgtaagccgtcttcagttaagagagcgagatgtatagaactcatcgacaacacagcctgttaagctctggtggagtgccatcgtttattggtgggctggtggtgtttgtgtcggcagcgttcaatgcacaagctgaaacctggttcgatcctgcttttttcaaagatgatccctcaatggtggccgatttgtctcgtttcgaaaaaggacaaaaaataacgccaggggtttatcgtgtcgatattgttctgaatcagacaattgtagatacgcgcaacgtcaattttgttgagataacgccagagaaggggattgccgcctgtttgacgactgaaagcctggatgcaatgggtgttaatactgatgcgtttccggcttttaaacaactggacaaacaagcgtgtgtgccattggcggagattattccggatgccagcgtaacgtttaatgtgaataaactccgtctggaaatttcagtaccgcaaatcgccatcaaaagtaatgcccgtggttatgtcccccctgaacgttgggatgaagggatcaacgcgctattactgggatattcgtttagcggggctaacagtattcatagcagcgcagacagtgattctggcgacagctattttctgaatttaaacagtggcgttaatttaggcccatggagattgcgcaacaattcaacatggagtcgtagtagtggccaaaccgcagaatggaagaatctcagcagctatttgcaacgggcggttattcctctgaaaggcgaactgaccgtaggtgatgattatactgcaggcgattttttcgatagtgtcagctttcgtggtgtgcagctggcgtcagatgacaacatgctgccagacagcctgaaagggtttgcgcctgtggtgcgtggtatcgccaaaagcaatgcccagataacgattaagcaaaatggttacaccatttaccaaacttatgtatcgcctggtgcttttgaaattagtgatctctattccacgtcgtcgagcggtgatttgttagttgaaatcaaagaagcggacggcagcgtcaatagctacagcgtaccgttctccagtgtgccattactccagcgtcaggggcgaatcaaatacgcggtgacactggcgaaatacagaaccaatagtaatgaacagcaggagagcaaatttgcccaggccacgttgcagtggggcggaccgtggggaacgacctggtatggtggtggacaatatgctgaatattaccgtgccgccatgtttggtctgggatttaacctcggcgatttcggagcaatttcgttcgatgcgacccaggcgaagagtacgctagcagatcaaagcgaacataaaggtcagtcatatcgttttctgtatgccaaaacgctcaaccacttgggcactaactttcaattgatgggctatcgctattcgacgtcgggtttctacaccctttccgacaccatgtataaacatatggatggctacgaatttaatgacggtgatgatgaagatacgccgatgtggtcgcgttattacaatttgttttacaccaaacgtggcaaactgcaggtcaatatctcccagcaattaggcgagtacggttcgttttatttaagtggtagccagcaaacttactggcatacggatcaacaggatcggctattacagtttggctacaacacgcaaattaaagatctttcgctggggatttcctggaactacagtaagtcccgtggtcaacctgatgctgatcaggtgtttgctctaaatttttccctgccgctcaatctgttgctccccagaagtaatgatagctataccaggaaaaaaaattacgcctggatgacctctaacaccagtatcgataacgaagggcacactacacaaaacctgggtttaacggagacattactcgatgacggtaacctgagctacagcgtgcaacagggatataacagcgaggggaaaacggctaatggtagcgccagcatggattacaaaggggcgtttgcggatgcccgagtgggctacaactacagcgataacggcagtcaacaacaactgaactacgctctttcaggcagtttagttgcccattcacagggcattaccctggggcaatcgctgggggaaactaacgttctgattgcagcaccaggcgcagagaatactcgtgtggcgaacagcaccgggctgaaaactgactggcgcggatataccgttgttccttatgccacttcttatcgggaaaatcgaatcgcacttgatgcggcgtcgttaaaacgtaacgtggatcttgaaaatgcagtagtcaacgtggttcccaccaaaggggcgttggttctggcggagttcaatgcccatgcgggtgcaagggtattaatgaaaacatcaaagcagggtataccgctgcgttttggcgcgatagcgacgctggacggcgtacaggctaatagcggcataattgatgatgatggctcgctctatatggcgggtttaccggcgaagggaacaataagcgtgcgctggggcgaagctcccgatcaaatttgtcatatcaattacgagcttaccgaacaacaaattaactctgcgattacgcgaatggatgccatatgcagataatctttggagaaaaatgcgtgtcattactacgactattttttgccgccgtcttaatgttatggtgcgctcaaaccgctgcttatagcgggcagtgtcatactactcaggggaatccgtatattggcgtcaattttggcgttaaaaccctggaggaagaagcaaatacggcaggggtagttaaagacaaattttatcagtggaacgaatcgaatgattattatgtttcctgtgattgcgataaagacaatgtcagaagtggccgatgggcattcgccgcggattcaccgttagtctatttaggcgacaactggtacaaaattaatgactatcttgccgccaaagttttattgcaggttaaaggcagttctcctactgcggttcctttcgaaaacgtgggcacagggggggatacccgatggcatatttgcgaccctggcggtcaacgtttaggtgggcagggggcaagcggtaatagcggtagcttttccctgaaaatattgcagccgttcgttggctcggtcgtcattcctcctatggcgctggcgcgattatatgaatgctacaacatacccgcaggtgattcctgcacgactacaggtacaccggttttagtgtattacctgtctggtacgatcaattcacttggctcatgttccgtcaatgccggagagacaattgaagttgatttaggtgatgtcttcgctgccaatttccgtgttgtagggcataaacctcttggggccagaacggcagaacttgcaattccagtcaggtgtaacacgggaaacgcgggattagttaatgtcaacctgagtctgacggcaaccacagaccccagctatccccaggcgattaagacgtcacgtcctggcgtgggcgtggtggtgaccgatagccagaacaacattatttcccctgctggtggaacattaccgctctctattcctgatgatgcagacagtatcgcgcgaatgaatgtctatccagtcagcacgacaggtgtaccaccagaaaccgggcgatttgaagccacggcaacggtgagaataaattttgattaacgcgtgaacgtatgaagaaaaaaacgatatttcagtgcgttatcttgttctttagcattcttaacatccatgtcgggatggctgggcctgaacaagttagtatgcatatttatgggaatgtggtcgatcagggctgtgatgtcgccaccaaaagtgcattacaaaatattcatattggtgattttaatatcagtgattttcaggccgcgaataccgtaagcactgctgctgatttgaatatcgatatcaccggttgtgccgctggtattactggcgcggacgtcctttttagcggcgaggctgacacccttgcgccgacactgctcaaactaactgacacaggcggaagcggtggtatggcaacggggattgccgtgcaaattcttgatgcgcaaagtcagcaagaaatcccgctcaatcaggtccagcctcttacgcccttaaaagccggggataacacactcaaatatcaacttcgttataagtccacaaaggcgggagcaacgggcggtaatgcgacggcggttctctattttgatctggtttaccagtgaaggagtgatgttgaaacggataatctggattctgttcttattgggattaacgtggggctgtgagctatttgcccatgatggcacggtcaacattagcggatcgtttcgccgtaatacatgcgtgctggcacaggatagcaagcaaatcaatgtgcagttaggcgatgtctcgctgacacgtttttctcatgggaattatggcccggagaaatctttcatcattaatttgcaggattgcggaacagatgtcagcacggttgacgtcaccttttcaggaacccccgacggagtgcagagcgaaatgttgtccattgaaagtggtacggatgcagccagcgggctggcaattgcgattctggatgatgcgaagatattgattccgcttaaccaggcgagtaaagactacagcctacatagcggtaaggtgccattaactttttatgcgcaattgcgacctgtcaatagcgatgtgcagtcgggtaaagtgaatgccagcgcgacatttgtacttcattatgactaatacgtggaacagattggcgctcttgattttcgccgttttatcgctgctggtggcgggtgaattgcaggcaggagtggtggtcggcggaacgcgatttatctttccggcagacagagaatcgatatctattttactgactaataccagtcaggaatcctggcttattaacagtaaaatcaaccgcccaacgcgttgggccgggggggaagcgtcgacagtgccagcaccattactggccgctccgccacttattctcctgaagcccggtacgacaggcacgttgcgcttgctgagaacggaaagcgacatcttgcctgtggatcgcgaaacgctatttgagttaagcattgccagcgtgccatccggcaaagttgaaaatcagagcgtaaaagtggcgatgcgctcggtatttaaactgttctggcgacccgaaggtttgccgggcgacccgctggaagcttatcaacaattacgctggacacggaattcgcagggtgtacaactcactaacccaacgccttattacattaacctgattcaggtgagtgtaaatggtaaagcgttaagtaatgtgggagttgtgccgcctaaaagccagcgtcagacaagctggtgtcaggcaatcgcaccgtgtcatgtcgcctggcgggcgataaatgattacggcgggttgagtgcaaagaaggagcaaaatctgccctgaaacaggttcggaaaacgtttgcgttttttttgccgcaggtcaattcccttttggtccgaactcgcacataatacgcccccggtttgcacaccgggaatccaggagagttcatgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatcgatcgagatcggtaccgtcacgccacgtccacagccaggtaatgacaagccgcgtctctttcgtctggtagatgccgaaggtttgatcaaccgtatgggctttaataatcttggcgttgataacctcgtagagaacgtaaaaaaggcccattatgacggcgtcctgggtattaacatcggcaaaaataaagatacgccagtggagcagggcaaagatgactatctgatttgtatggaaaaaatctatgcctatgcgggatatatcgccatcaatatttcatcgccgaataccccaggattacgcacgctgcaatatggtgaagcgctggatgatctcttaaccgcgattaaaaataagcaaaatgatttgcaagcgatgcaccataaatatgtgccgatcgcagtgaagatcgcgccggatctttctgaagaagaattgatccaggttgccgatagtttagttcgccataatattgatggcgttattgcaaccaataccacactcgatcgttctcttgttcagggaatgaaaaattgcgatcaaaccggtggcttaagtggtcgtccgcttcagttaaaaagcaccgaaattattcgccgcttgtcactggaattaaacggtcgcttaccgatcatcggtgttggcggcatcgactcggttatcgctgcgcgtgaaaagattgctgcgggtgcctcactggtgcaaatttattctggttttatttttaaaggtccgccgctgattaaagaaatcgttacccatatctaattatttcttcgaattcctctttataagataatcagggctttattttcagccctggttgttttatattcatcgctgttgcttatttagacattttgtacttttattgttgaggttattaagcgaagcgacaatggattgtgttgctgcggttttatagggtaggggagaggcagatgcgaattaaaccagacgataactggcgttggtattacgatgaagagcacgatcgaatgatgctcgatttagccaatggtatgctatttcgctcacgttttgcgcgcaagatgttgactccagatgccttttctcccgcaggcttttgcgttgacgacgccgcgctctatttctcttttgaagaaaagtgccgcgattttaatttatctaaagaacaaaaagccgaactggtgctgaatgcactggtagcaattcgctatctcaaaccgcaaatgccgaaaagctggcattttgtttcccatggtgaaatgtgggtgcccatgccgggcgatgcggcctgcgtttggttgagcgatactcacgagcaggtcaatttgctggtcgttgaatctggcgaaaatgccgcactatgcctgctggcacaaccctgcgttgttattgcgggtcgcgcgatgcagttgggcgacgccattaaaatcatgaacgacaggctgaaaccgcaggttaatgttgacagcttcagcctcgaacaggcagtctaacgcgccaacttaagtgcagtcttcggtacacagctacagcaaagaatggtgccatcatcgcccattgctgattttttcagcggcgtgacttcgccttctaaaagctgaacacggcaacttccacaaatgcccgcgcggcaagaataagggatacgaattccctgattttctaattgctccagcaacacctgttggttatttccacgaaatgcctgtccctgccagtcaatatctacatttgcgtccggttgttgcgtgatgttggcggtatcatcagcggcagctgcgccgtaaatttttgccggagccgttgccagaatttccacctcatcgccaacgcgaatcacgccgctattacgggcaattaaattctgaccaaaatcgacatcgccgttatcctgggcagtgcggaaagattgcaatgtttttaatggttcgcctgccggatgtttttgccctttttctgggctgacggtggtgaaaatacagcggctacaaggtttaaccacatcaaacaccacatcaccaatgcgaatcactttccagcgatcttcttcccaggctgacgcgccggaaaccaccagattggggcggaattgctccatttttacactggccggacaacgttgttggagatcacgtaacgaggcttcgttagcaagaaggtaaggatagccatcagcaaatgacagaggtacagtgttgtggcgtttcacgcgccgggtcatttgtggccccacccagcgtaattgcacttcgcgggagaaaaatccacttagccatttgttgatcgcgtctggcgcaattcgcgcggtaaaatgtgtgccccaaacttcggttggtgcgtcttgtgtggcgaaatcagcaaaacgaacatatgcgctactgccatctggtgcggtgagatgcaagccatcatgcacaggtgaaggagtaaaccgtaccatctggggaaactggcgagcggtaataaacgtaccgtcaggttccgtgatcataaagatgcgatcgaaggccagaccactgacatctgccagagcatgtgtaagaccaatgccgcgcatcgatttaacaggatgaataaaaagccggattaatgtcgccacggtgcggtcctcaaatgaaaataagccctcaactttatgacatgacgcgcttattagctataatgcgcaacaattttcttagcgcctgtcccattaggctattttatttgtcagtttggccctgggttatgctcgaaatcctcacgtacttgtgtacgctccggtttctccgcgctgtccatgtccagactgactgcaacaattacgcctactgcggtaggctcttagagtaaaagtgacgatatgaattctctgtttgccagtacggcccgtgggctggaagagctgttaaaaactgaactggaaaacctgggggccgttgaatgccaggtggttcagggtggggtccatttcaagggcgacacacggcttgtttaccagagcctgatgtggagccgcctggcctcgcgtattatgttgccgctgggcgagtgtaaggtttacagcgatttagacctctatctcggtgttcaggcgatcaactggacagagatgtttaatcctggcgcgaccttcgctgtccacttcagtggtttgaatgacaccatccgcaacagtcagtacggcgcgatgaaagtgaaagacgcgatcgtcgatgctttcacgcggaaaaatctgccgcgtccaaatgttgatcgcgatgcgccggatatccgcgttaacgtctggctgcataaagaaaccgccagtatcgctcttgatctgagtggtgatggtttacatctgcgtggctatcgcgatcgtgctggtattgcgccgatcaaagaaaccctggcagccgctattgtgatgcgatccggctggcagccaggaacaccgctgctcgatccgatgtgtggttccggtacgttgctgattgaagcagcgatgctggcgaccgatcgcgcaccaggcttgcaccgtgggcgttggggctttagcggctgggcgcagcatgatgaagctatctggcaggaagtgaaagcggaagcgcaaactcgcgcccgtaaaggcctggctgagtatagctctcatttttacggttcggacagcgacgcacgggtgattcaacgtgcacgcactaacgcccgtcttgcggggattggtgaactgatcacctttgaggtgaaagatgtcgcgcaactgaccaatccgctgccgaaagggccgtacggcacagtgttgagcaacccgccatacggggaacgtctggacagcgaaccggcgctgattgcgctgcatagcctgctgggtcggatcatgaaaaaccagtttggtggctggaatctctctttgtttagtgcctcgccggatctgctaagctgcttgcagctgcgtgcagacaaacagtacaaggcgaaaaacggcccgctggactgcgtacagaaaaattaccacgttgccgaaagcactccagacagcaaaccggcgatggtagcggaagactacaccaaccgcctgcgtaagaacctcaaaaaattcgagaagtgggctcgccaggaagggattgaatgttaccgcctgtatgacgccgatctgccagaatataacgttgccgttgaccgttatgccgactgggtggtggtgcaggagtatgcgccgccaaaaactattgatgctcacaaagcgcgtcagcgtctgttcgatattatcgctgcaaccatttcggtactggggattgcgccaaacaaactggtgctgaaaacccgtgaacgccagaagggcaaaaaccaataccagaaactgggcgagaagggcgagtttcttgaagttaccgaatataacgctcacttgtgggtgaacctgacggattatctcgatactggtctgttcctcgatcaccgcatcgcccgtcgtatgctcggtcagatgagcaaaggcaaagatttcctcaacctgttctcttataccggcagcgccaccgtgcatgcgggattaggcggtgcacgcagcaccaccaccgtggatatgtcgcgtacttatctggaatgggcagaacgcaacctgcgtctgaatggcctgaccgggcgtgcgcatcgcctgattcaggccgattgcctggcgtggctgcgtgaggcaaatgaacagttcgatctgatctttatcgatccgccaaccttctctaactcaaaacgaatggaagatgcgtttgatgttcagcgcgatcatctggcgctgatgaaagatttgaaacgtctgctgcgtgcaggtgggacgatcatgttctcgaacaacaaacgtggcttccgtatggatctcgacggcctggcaaaactgggactgaaagcacaagaaattacgcaaaaaacgctctcccaggatttcgcccgtaaccgccagatccacaactgctggctgattaccgcagcctgaaaggaatagtaatgtcattaatcagtatgcatggcgcatggctgtcgttcagcgacgcgccgcttctcgataacgcagaactgcatatcgaagataacgaacgtgtttgtctggtgggccgcaacggcgcaggcaaatcgacgttaatgaaaatcctcaaccgtgaacaagggctggatgacggtcgcattatttacgagcaagatttgattgtagcgcgtctgcaacaggatccgccgcgtaacgttgagggtagcgtttatgatttcgttgccgaaggcattgaagaacaagcggaatatctgaaacgctatcacgatatttcgcgcctggtgatgaacgacccgagcgagaaaaatctcaacgaactggcgaaggttcaggaacagctggatcaccacaacctgtggcagctggaaaaccgcatcaacgaagtgctggcgcaactggggttagatcctaacgttgcgctgtcgtcgctttccggcggctggttgcgtaaagcggcattaggacgcgcgctggtgagtaatccgcgcgtgctgttgcttgatgaaccgacaaaccacctggatattgaaaccatcgactggctggaagggtttttgaaaactttcaacgggacgattattttcatctcccacgaccgttcgtttatccgcaatatggcgacgcgcattgttgatctcgatcgcggcaagctggtgacctatccagggaattacgaccagtacctgctggaaaaagaagaagccctgcgcgtggaagaattacaaaatgccgagttcgatcgcaaactggcgcaggaagaggtgtggatccgccaggggatcaaagcacgccgtacccgtaatgaaggccgcgtacgcgccctgaaagcgatgcgtcgcgaacgtggtgaacgtcgcgaagtgatgggtaccgcaaagatgcaggtggaagaggccagccgctccggtaaaatcgttttcgaaatggaagacgtttgctaccaggttaacggtaagcaactggtgaaagatttttctgcccaggttctacgtggcgacaaaattgccctgattggtccgaatgggtgcggcaaaaccacgctgctaaaactgatgctcggtcagcttcaagcggacagcgggcgtattcacgttggcaccaaactggaagtggcttatttcgatcagcaccgcgcggaactggatcccgataaaacggtgatggataaccttgccgaaggtaagcaagaggtgatggttaacggcaagccacgccacgtattgggctatttgcaggactttctgttccatccgaaacgggcgatgacgccggtacgtgcgctttctggcggtgagcggaaccgcttgctgctggcgcgtttgttcctcaaaccaagcaacttattgattcttgacgaaccgaccaacgatcttgatgtcgaaacgctggaactgctggaagaactgatcgacagctatcagggcacggtattgctggttagccacgatcgtcagtttgtcgataacaccgttacagaatgttggatcttcgaaggcggcggtaaaattggtcgttatgtcggcggttatcatgatgcccgtggtcagcaagagcagtatgtggcgctcaaacagcctgcggtgaaaaaaaccgaagaagccgccgcggcaaaagcagaaactgtaaaacgcagcagtagcaaactaagctataaattgcagcgcgaactggagcagctaccgcaattgctcgaagatctggaggcgaagctggaagccctacagacgcaagtggcggatgcttccttcttcagtcagccgcatgagcagacgcaaaaagtgcttgctgatatggctgctgcagagcaggagctggagcaagcctttgaacgctgggagtatcttgaagcgttaaaaaatggtggctgatcgcaaaatagtcgatttaaacagagacagctgacaacggtaaaattgcctgatgaactgggtttatcaggcatgaaaaccaacactttgttagtcatctgtaaaatagcgcatcattaaggagtaccaatgtgcgaacatcatcatgccgcgaagcacatcctgtgctcgcagtgtgacatgctggtggcgttaccgcgccttgagcatggtcagaaagcggcatgtccccggtgtggcacaacgttaaccgtggcgtgggatgcccctcggcagcgtcccaccgcctatgcgttggctgcactgttcatgctgttgctgtccaacttgtttccttttgtgaatatgaacgttgcaggagttaccagtgaaattacattactggaaattcccggcgtgcttttttctgaggactacgccagcctcggcacctttttcctgttgtttgtgcaactggttcccgcgttttgtctgataaccattctgttactggtgaatcgcgcggaattaccggtccgtttaaaagagcaactggcacgggtgctttttcaactcaaaacctggggaatggcggagattttcctcgcgggtgtgctggtcagtttcgttaaactgatggcttacggcagcattggggtaggcagcagctttctcccctggtgtttattttgtgtcctgcaactgcgcgcttttcagtgcgttgatcgtcgctggttatgggacgacatcgccccgatgccagaactgcgccagccgctaaaaccaggcgtcacggggatacgtcaggggctgcgttcgtgctcctgttgtacggcaatccttcctgctgatgaacccgtgtgcccgcgttgtagtaccaaagggtacgttcggcgtagaaacagcctgcagtggacactcgcgctgcttgtaacgtccatcatgctgtatcttccggctaatattttgcccatcatggtgacggatttattaggctcgaagatgccgtcgacgattctcgctggggtcattctgttatggagcgaaggctcttatcccgtcgctgcggtgatctttctggccagtattatggtgccaacgttaaagatgatcgccatcgcgtggctgtgttgggatgccaaagggcatggcaagcgcgacagtgaaagaatgcatttgatttatgaagttgttgagtttgtaggccgctggtcgatgattgacgttttcgttatcgcggtgctctcggcgctggtgcgtatgggaggtttaatgagtatttatccggcaatgggtgcattaatgtttgctttagtcgtcataatgacaatgttttctgctatgacgtttgacccgcgtttgtcgtgggatcgtcaacctgaatcagagcatgaggagtcctgacagtatggaatctaataatggggaagccaaaatccagaaagtgaagaactggtctcccgtgtggatatttcctatcgtcacggcgctcattggggcctgggttcttttttatcattacagccatcagggaccggaagtgaccctgatcaccgcgaatgcggaaggaattgaaggtggcaaaaccaccattaaaagccgtagcgttgacgtcggcgtggttgaaagcgccacactggctgatgatttgacgcacgttgaaatcaaagcgcggctgaattccggtatggaaaaattgctgcataaagacaccgtcttttgggtggtgaaaccgcagattggtcgcgaagggattagcggcctgggaacgctgctgtctggagtttatatcgaactgcagccaggcgcgaaaggcagcaaaatggataaatacgatttgctggactcgccaccgttggccccgcctgatgcgaaaggtatccgtgtgattctcgatagcaaaaaagccgggcagctctcgccaggagatccggtgctgttccgtggctatcgggtaggttcggttgaaaccagcaccttcgatacacaaaaacgcaatatcagctatcaactgttcatcaatgcaccttatgaccgactggtgaccaacaatgttcgcttctggaaagatagtggcattgcggttgatctgacgtcagcagggatgcgtgtggagatgggctcattgacaacgctgctgagtggcggtgtcagctttgatgtgccggaaggtctggatttagggcagccagtggcaccgaaaacagctttcgttttgtatgatgatcagaagagcattcaggattcgttgtacaccgatcacattgattatctgatgttctttaaagattcggtacgcggtctgcaaccgggagctccggtagagttccggggtattcgcctgggtaccgtaagcaaagtgccattctttgcgccgaatatgcgtcagacatttaacgatgattaccgtattccggtactgattcgtatcgagccagagcggctgaaaatgcagcttggcgaaaatgcggatgttgttgagcaccttggcgaattgttgaaacgtggtttacgcggatcgctgaaaaccggaaacctggtcactggtgcactgtatgttgatctcgatttctatccaaatacgcctgcaataaccggtattcgtgaatttaatggttatcagattatcccgaccgttagcggcggcctggcgcaaatccagcaacgactgatggaagcgttggataagatcaacaaactgccattgaatccgatgattgaacaggcaaccagtacgctttctgaaagtcagcgcacaatgaaaaacctgcaaacgacgctggatagcatgaacaagatcctcgctagccagtcgatgcagcagttgccgacggatatgcagtcaacgttgcgtgaattgaatcgcagcatgcagggcttccagcctggctccgcagcctacaacaagatggtggcggatatgcagcgccttgatcaggtgttgcgagaactgcaaccggtgctgaaaacgctcaatgagaagagtaacgcgctggtatttgaagcgaaggacaaaaaagatccagagccgaagagggcgaaacaatgaaaaagtggctagtgacgattgcagcactgtggctggccggatgcagctccggcgaaattaataaaaactattaccagttacctgtggtgcagagcggtacacaaagtaccgccagccagggcaatcgtctgttatgggtagagcaggtcactgttcctgactatctggcggggaatggtgtggtttatcaaaccagtgatgtgaagtatgtgattgccaacaacaacttgtgggccagcccgttggatcaacagttgcgcaacaccctggttgccaacctgagtacgcaactgcccggctgggtggttgcctcccagcctctgggaagcgcccaggacacgctcaatgttaccgtaacggagtttaacggtcgctatgatggcaaggtcattgtcagtggtgagtggctgttgaaccaccagggacaactgatcaaacgtccgttccgtctggaaggagtgcaaactcaggatggttacgatgagatggttaaagtgctggccggtgtctggagtcaggaagccgcttctattgcacaagagataaagcgtctaccttaattataaagatttgtaaatataaccgtctccggtatgttgcctgaggcggtttttttgtctctaacgtgcggaaaaatttgttcctcttcacattttttgtacaaccgacatgcccgtgtagctcacaaatatgacagtggcgtgaattttgcgcattgacggcagttatgattcgcggtattgcttaactgtgattgcacatttagtaatcactgttttcttttccaccagaaaccagtatgagggaaacgaggcatgaagagacaaaaacgagatcgcctggaacgggcacatcaacgtggttatcaggccggcatcgccggacgctcaaaagaaatgtgtccctatcagacgctgaatcaaaggtcacaatggctgggaggctggcgagaagccatggcggacagggtagtaatggcctgattctgtctctttaaaaagaaacctccgcattgcggaggtttcgccttttgatactctgtctgattataatcagaaggcagacgtatcctggaacagaccgactttcaggtcgctggcggtatagatcagacgaccatcaaccagcacttcgccatccgccaggcccataatcagacgacggttaacaatgcgtttaaagtgaatacggtaggtcacttttttcgctgtcggcagtacctgaccagtgaatttcacttcgccaacgcccagcgcgcggcctttaccttcgccgcccagccagccgaggtagaaccctaccagctgccacattgcgtccaggcccaggcatcccggcataaccggatcgccaataaagtggcatccgaagaaccacagatccggattgatatccagttctgcttcaacataccctttgtcgaagttaccacccgtttcggtcattttgaccacacggtccatcatcagcatgttcggtgctggcaattgcgggcctttagcgccaaacagttcaccgcgaccagaggcaagaaggtcttcttttgtataggattcgcgtttatctaccatgttctctgtaagccttattttattgaagcacgcaggatagctaacacgtgtacgctgaacaagtccgatcagttcggaataaaccagttcagccaacgtaatggccatggaaaacggtgacgtccttcctgttgcgatgcttgcgcgatacgttcctggatggtttgcatcagcgtcgtttggccttcgccatcccacaccagatttaataataacggcagtgcgtcagtcacatcgtctactgcccagatggtgaatttgccttcttctaccgctttcaccagttcactgtgaagacttaaatggcgaacgttagctgtggggataatgacaccttgtttcccggttaactcacgttgctggcaaatagcaaagaagccttcgattttctcatttaaaccaccgaccggctgggcgcgaccgaactgatcgactgaacctgtgatagcgatactctgattcaccggcacatcggcgagggcgcttatcagggcgcagagttcagccatcgaggcactatctccatcaacttcactgtatgactgctcaaatgtcagcgatgctgagaaggggatctgttgctcaagctgtagttccgacatcaggaacgcttgcatgatcatcatccctttcgcatggatattgccgccaagctccgctttgcgttcgatgtcggtgaattcaccatcgccaatatgcacaacgcagctaatgcgagaaggttcgccaaaagcgcgtggatgacccggaaattcaatgaccgaaagggcgttaatttgcccgatgcgttcgccttcggtttcaatcaggatttgctcctgaaggatctcatcctgcatacgttcagcgaggaaaccttcgcgccattcacgctgctgcagcattaagtttagctgctcgccggagaaggtgtcgccatcacacagggaggcgacctctttacactggcggaggatccactgcgggctaagcggaagtgtttcttgttcaccggtgtagcgtgctgcttcgcggataagtatcggccaggcatccgctcccggtgcaggtaagtgattatgtctggcggtaaatgtcacccagcgacaccactgggttactgactccgcatcgacaatctgcagagtatcttcaaattcgctataaatagcctgctctgaaagctctggctccatctcctggaaatcagccaatgattcgcgttcgcctaccagaatgactttcagcttcaatggcatcgaaggcacagagacggggagagggcgcgactcatcaaacgcaacccagtcaaaacgctcgcggttaacgatatttttcagccgcatccacagcagaggttgcgccagcagtgtacgcaaagagataatgagaataccgccatttgcctgatgcaccagaccaggctgcagggtaatgtcgccattaaactggcgcaggcagccaaagagttgctccgcttctacccagtcggcagcgacaacttgcgttaaagtcgcaaaattatcatctgcactcactgcgtgacgtaagcggatggagtggccggaaacctcatagtgaccgcccaccagttggcctgcatcgctttgtagcgtacgcgcggcattggcaataagattcagatactcagactcttccggggccttcgccagcataaaagaggaggatgctcgcgtatgcagcaactgctccagcgcaaattgcagccgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcgattataccgtaaccggcactacagcacacgtagaaagcaccgacaatactcctggcatgggcgttaaagctcacaggatggagattcttttcttcactggcctaaaaagctgatattctgtaaagagttacacggtaacattgagatcgctatgaaatatcaacaacttgaaaatcttgaaagcggttggaaatggaagtatctggttaagaagcatcgcgaaggggagttaatcacccgttacatagaagccagtgccgcccaggaagccgtcgatgtgttgctctcgctggaaaatgaacccgtgctggtaaatggctggattgacaagcatatgaatccggaactggtcaatcgcatgaagcaaaccattcgggcaagacgaaagcgccattttaatgcggaacaccagcatacgcgcaaaaaatcgatcgatctggaatttattgtctggcaacgtctggctggtcttgcgcagcgtcgcggtaaaacgctttctgaaacgattgttcagctgattgaagatgcggaaaacaaagagaaatacgcgaataaaatgtcttctctgaagcaggatctgcaggcattgctgggtaaggaataactgacgaaagtcagttcaatttactaaaggcaaaaaaaaccccgcagcagcggggtttttctaccagacgagaacttaagcctgcggctgagttacaacgtctttgatacctttaacttcgatctctacgcgacgatccggagccaggcagtcgatcagtgcagcacgctgtttcacgttgtcacaggtgttgccagtaaccgggttggattcgcccataccacgtgcggagatcttgtctgccgggatacctttggagatcaggtaatcaacaacagactgagcacggcgctcggacagaccctggttgtaagcgtcagaaccgatgcggtcggtgtaacccagaacaactacggaaccgtctttcggatccaggttgctcagctggctgtacagctgatccagagcagcctgaccttccggtttcagggttgctttgttgaagttgaacagaacgtcagacttcagagtgaagtgcttggtctgtacttccggtgccggagctggagccggagcaactactggagctgcttcgccctgaccgaaacggtaggaaacacccaggctcagcatgccgttgtccggacgagtgccgatggtgtgtgcgtcaccgatgttgttggtccactggtattccagacgggtagcgatttcaggagtgatcgcgtactcaacaccgccagcgaagaccggagaaacgccggtgtcgtggtttttaccataaacgttggatttagtgtctgcacgccataccatgccacccagacgagtgtagatgtccaggtcgtcagtgattgggtaacccagtttagcggtcagttgaacgccctgagctttgtatgcaccgttttcaacgctgcctttgtacggcatacgacctaaccagtcgtaacccatttcaaagccaacatacgggttaacctggtaaccaccaaaagcaccagcgcccagttggttttcatgggtcgggccattgttgttgatgaaaccagtgtcatggtactgggaccagcccagtttagcaccagtgtaccaggtgttatctttcggagcggcctgcgctacggtagcgaaaccagccagtgccactgcaatcgcgatagctgtctttttcattttttgcgcctcgttatcatccaaaatacgccatgaatatctccaacgagataacacggttaaatccttcaccgggggatctgctcaatattaactctaccgatatcttcggcttatgccgagcacccctggcgatgtaaagtctacaacgtagttgaaaacttacaagtgtgaactccgtcaggcatatgaaaaaaaagtcttgtataaggtatgtttaatcttttttgtcagcgacaatttacagaagagaatcgcggaaaccgcttcagacaagcctccgcaaggaaaattagtcacgactgaaagcattggctgggcgacaaaaaaagttccaggattaatcctaaatttacttaatgatacaaattagagtgaatttttagcccggaaagttgtctcgtggcgtgagaggatgcgcttaccggacgcataataaaccccatagcgttaccttcatttgccgcatcaacaagttcagcatgctcttcttcagtcaaatcatctgccaaccaaccgatcaccacactgtaattgcccgtgcgtaaagcgcgaaccattgactccacagtgtggcaaggggagagctggctaatctgcattactttcgttaagggtagcccagatgcctgaacccattcccgactcagtttttgttgcggtgttaaccagagttgccagcgcgattgctgaccgagttgctgtaacaatggcaacagtagaagttgcgtcatcatgggctgatcttcgcgatagacaacttcactgataagcccggctgtagtgttttccgtagagacacgcgcaattttacttgctgcggatgagaacgacgaagaacgatgtgcatagcctgaagtgtacataatcaatccagcccctgtgagttactgtatggatgtacagtacatccagtgacaacaaagatcaaccctattttcggaaagagcctcgcaaattttgtcgttggtgacgggaaaacataaattaatcttgccccttaagaataagttgcctattttcgtagttaacggatccgttaatgtgaatcattcttttatgttatgattttaaaaggaattttatgaaaagcctctcctataagcggatctataaatcacaagaatacctggcaacgttgggcacaattgaataccgatcattgtttggcagttacagcctgaccgttgacgacacggtgtttgcgatggtttctgatggtgagttgtatcttcgggcttgtgagcaaagtgcacagtactgtgtaaaacatccgcctgtctggctgacatataaaaagtgtggccgatccgttaccctcaattactatcgggttgatgaaagtctatggcgaaatcaactgaagctggtgcgtctgtcgaaatattctctcgatgcagcgctgaaagagaaaagcacgcgcaatacccgggaaagactgaaagatttgcccaatatgtcttttcatctggaagcgattctcggggaggtggggattaaggatgtacgggcgttacgtatacttggggcaaaaatgtgttggttgcgactgcggcagcaaaacagtctggtgacagaaaagattctgtttatgcttgaaggtgccattatcggcattcatgaagctgcgctcccggtggcacgccgccaggagcttgcagaatgggctgactctcttacgccgaaacaggagtttcctgcggaacttgagtaatctggcgttgcagacgaccaatctcaggcagtaatgcaatcaataatccaacttgttgtacgaccagaggttctttgctgtctgcccgtggttcaagttgctgcatccgctgtttcaggctagctaatgcctcattgacgcgttcttcatcagcaggttgatgatgtaacgcgtcatcaacatagcaaactgcgtcatcaagaaacgccagaatttcaggattagttaactgctcccggtgagcaccgagggctgagatatagctggtaaacgtatggttaaggcacagcaaccgaaacgcggcttcgcgaatttgcggggtaacgttcggctcgctggacatatttgataccaccgacgccagctcagcatcacggttgtgtgcatcgcggcgggcaatacgatacgccagacggttatcacgcccctgatggtattgctccagtatggcatcgagataccgacagttggcctctgtggcgcgttcgagcatgcgcggcagattgcgaaactgccagtcaggccagatgtagctcactgccgcccacgcaatggcacaaccaatcagcgtatcgattacgcgaggtaacgctacttcaaaaccttcacccagtaagttaaaacacagtagcaccaaaagtgtgatgaacatcgttgcatgagcgtattgcacgttacggaaggcaaaaaagagcacgccggtaataaccagcagcaccagctgcccttccagtgatggcacaaaccacagcacaggaatgccaatggcgatacctaccagcgtaccaataatccttaacttcaggcggtggcgcgtggcgttatagtttggctggcagacaaacaaacttgtcagcaagatccaatacccgtgatgcattccggttatctgaatgatggcgtagccgaagcacaacaccagcgacattcttaccgcatgacggaagagggcggattccggcgtgaagtgacggctaagacgcagccagatatcactcaacccgtgcgggctgtcatcagcgagctcattttcgtcattattatggggtagtgcctgggcctgttctgattcaattgttgccagttgggcatcaatggcgcgtaaattgttcagcaaaaatcccagtgttttgagtaaatcggcgggtgcgccgttatcgcgcatccgctccagcgcagcatcaatatgcgtaaaagcgcgctcaaaatgcggatcatgttgataaggctgacgcaacaaaatacagcgtgacagttgctggcacgcctggccctgcatcgacatcagccgctgaaaacggaacagcacgtcgctgtggcgaaaatgttcacgcaatgtttgatactgaatatgagaagagctggcacgctcgtgaatatcctgtgcgacaaagtaataatgcagcgtgcgacgcgttccccgttgaccacgatcgccacgtaagcgggtcagcagcgagagtttcgtctgattcaatgtcgccatcagcagaccgttggcgagagccaaatcgtacagcggtgcctggctttgatcttcaatatcaggatcaaacatgcgcgacttgagctcaagataacgcgccagttgttcatagcaacgcgccaggttgtcctgcagcgggcggaccgggaacagcagatgaccaataagtgtcaggacgttgtaccagacggcaccggccagcagatacatcggctgctgataccagtgctcatacagtgatgttcccaacatagtgtaaatggcgatcagcaatgcaccgaaggcaattgttgcatagcgttgacccagaccgccgagcaaaatgaagccgctggtagagagcgttaagccaatcgcaaatagccagggccagggaaacagcaattctactgaggccgaggcgataaaaaagcagaacagcgtaatgatgaggttacgcaaacgtcccgccagtcggtcatcgagatcggtcagcgccgctgccaccatccccagcgttagcggaatcgtcagttttacatcacccagccaccacggaaacgctgtggttccacaaagcgcaataaaaatacgcgcgtaatacagccaggcgctgttccaggtatagcgtttgagcaaaggacttagcataaaggccatattagtggattattcaaaacgacgacgtgcattggcttcacgcgcagcttgcgctgtttctaccgataccacgcgacgaccaaccggccatagtgcaatagcggcaattttaaagttcgcaatgccgacaggaatgccaatgattgaaatacattgtgcgatgcccgttgcaatgtgcatcaggcataaccaccagccaaagaaaatcagccagaaaatattcaataccgtaccgccagtattcagcagcacatttttgccagccgggttcagttcatcgacatgaatagcttcattgccataaggcaccagagacagtttagtgatctcccagcaggatcgtgtcagcggtaaggtaaaaatcagcacaatactgaccagagtcgccaacagccagcccagagtggtggcaaatccgccaagcacaaagttcagaatgttcaaaacggtacgcataaaacctcgctttactgtggttttcagtaatgggcggcaattgtaacgtttttttgggctggagcacgttttctctgacggttacactgataagaaataatttcgtgtggatctacagagtcatggaactgaaagcgacaacgcttggaaaacgtctggcacagcacccttacgatcgggcggtgatcctcaatgccgggattaaagtctccggcgatcgccacgaataccttattcctttcaatcaattactggcgattcactgtaagcgcggtctggtatggggcgagctggaatttgtactgccggacgaaaaagtggtgcgtctgcacggcaccgaatggggcgagacgcagcgtttttaccatcatcttgatgctcactggcggcggtggagtggcgagatgagcgaaattgcgtctggtgttttacgccagcaactggatttgattgccacgcgcactggggaaaataaatggctgacgcgtgagcaaacctctggcgtgcagcaacaaatccgccaggctttgtcggcgttgccgttgccggttaaccgactggaagaattcgataactgccgtgaggcgtggcgtaaatgtcaggcctggttgaaagatattgaaagcgctcggttgcagcataaccaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgcaggctggttgctggcgcgtggtgaagcgtcccctgagcaaattttattgctggcgtttggtcgcaaagccgctgaagagatggacgagcggattcgcgaacggctacataccgaagacattaccgcacgcacgtttcatgcgctggcgctgcatattattcagcagggcagcaaaaaagttccgatagtcagcaaactggaaaatgataccgctgcccgtcatgaactctttattgctgagtggcgcaagcaatgcagcgaaaagaaagcgcaggcgaagggctggcggcaatggctgacggaagaaatgcagtggtcagtgccagaaggtaacttctgggatgatgaaaaattacagcgtcgccttgcctctcgcctcgatcgctgggtaagtctgatgcggatgcacggtggtgcacaggcagaaatgattgccagtgcacccgaagagattcgcgatctgttcagtaaacgtatcaagttgatggccccgttattaaaagcctggaaaggtgcgctgaaggcagaaaacgctgtcgatttttcgggccttattcatcaggcgattgtgattctggagaaaggtcgctttatcagcccgtggaagcatattctggttgatgaatttcaggatatctcgccgcagcgggcagcgttgttagcggcattacgcaagcaaaacagtcagacgacgttgttcgctgttggtgatgactggcaggcgatttaccgattcagcggtgcgcaaatgtcgctcaccaccgctttccatgaaaactttggtgaaggcgaacgctgtgatttagacacgacttaccgttttaacagtcgtatcggtgaggtggcaaaccggtttattcagcagaacccaggccagctgaaaaagccgctaaacagcttaaccaatggagacaaaaaagccgtcacgttattggatgagagtcaacttgacgctttgctggataagctctctggttatgccaaaccggaagagcgcattctgatcctggcgcgttaccatcacatgaggcctgccagcctggaaaaagcggcaacacgctggccgaagttgcaaatcgactttatgaccattcatgccagcaaagggcaacaggcggattacgtcatcatcgttggcttgcaggagggaagtgatggttttccggctgcggcgcgggagtcgattatggaagaggcgctactgccaccggttgaggatttcccggacgctgaagaacggcggttaatgtacgtggcgctgacccgggcacgccatcgggtatgggcactgtttaacaaagagaatccctctccctttgtggaaatactgaaaaatctggatgtgccggtggcgagaaaaccgtaagaaacaggtggcgtttgccacctgtgcaatattacttcagacggtccgcgagataacgctgataatcggggatcagaatatcgaccgcgtcgttgaaatgcggcgactggattatgaagtctgccgttgccacgttggtggcgaccggaatgttccataccgtcgccagacgcagcaaggctttcacgtcaggatcgtgcggcacggcatttagtggatcccagaagaaaatcaatacatcaattttcccttctgagatcaatgcgccaacctgctggtcaccccccattgggccactcaacatcgcgttgacgttcatgccggtcgcgcgggaaattaagttaccggtagtgcctgttgcatacagtacgtgttgttccagtaacggttgatgccgttccacccagctcatcagcatttgtttgcagtgatcgtgtgccaccagcgcaatatgtttccgcgcaggtaaagtgcgagtcgtcagttccataatgtacatccgtagttaactttcctacagattactgtaagcacttatcgctgcaagataaagaccgaaaaagcctgcgcacaggcacaaaaatctcaggaagatggttgtttttccgcccactgcaggaaagtatttcgcgtttgtgggtcagccagtttaaaccaatacttcagccgttgttctgtgagcacctgagactgcggtggaatagcatccagctcggaaacacccgaaagcagcgtactgtcatctgccatcatcgtggcaaattgcggtagtgaagcgcgtttcgcggatttgttatagcgttcaacctcgacctcataatcaatcgtttttgccgttgaggtaatggcgagaatatccagctttaccggaatcggcgtcgcatcgccatccaacaattcaaggcgcggcgcggcatcaaaatggttagcttcccgctcattctccaggcgaggcaggcgaaaattgacctggttgatgagctgggtattaaaactgaccaccagcggtggggagatatacagccgttcttcactattggaaagatgaatcgtcttctcaacgcgaaacactaactgatgcggtccattatccagttcaatgctgtccgcaccgcgcagcagagagctggaaaccttcttgccgtcgagtaccagaagatcgacatcggttgaaagccgcagcgtggtggcaaaaacggataccggcaaacataatgcaatcaaggtggtcacgatgccggttttcataggtagctcctgtcaaaagaccgcccgaataataatgtgtcaaaatttttctttaatcatacttactaacatatagacatatttcccgcttttgctctcattcattcgtattagctgcatggttggcatgtcggctttgtcgtacactttgttaaacagtctggaggaaataatgaaagaaaccgatattgcaggcattttaacgtccactcacaccattgcgctggtgggggcaagcgacaaacccgatcgtcccagctatcgcgtgatgaaatatctactcgaccaggggtatcacgtcattccggtttcgccaaaagttgccggcaaaacgctgctgggccagaaggggtatggcacgctggcagacgttccggaaaaagtcgatatggtcgatgttttccgtaattcagaagcggcgtggggcgtggcacaggaagctattgccattggcgcgaaaactctctggatgcaactgggggtgattaatgagcaagcggcagtactggcacgggatgccgggttaaatgtggtgatggatcgctgcccggctattgagatccctcgcctgggcctggccaaataaaaaatccccggaaggcaaaaaccttccggggatttgttcagggattagttacgcagacgcggggcctggagttgtttgcggatggtctgcgccagctcatccatggatggctgttcaggatgttcatcctgcaattcgctacttagctgggcttcagccaggtaggtatgaaccggtaggccgttatcgtcctccatcactacgtgataccacggagcggcgcgaagctcgtcattcaccgccagctcatcaggcgacggttcagagagcgaataaaccgggtcgatatccacgaccactccgagataacctaacagggaatggcggacctgctggccgataccgaatttgctggcaatcatagtcacctcccgggaaatctttacctttgatataagggtaaaattccacatttcaagttacatgacgcgacaggcaaaccctttcagatatagcccttccggataggtagcgatcaccggatgatcggctgcctgacggaactgctctataaattgtacatcacgaccggcatcaattgcggcatccgcgatgattttctgaaataaatcgctggtcatcagaccggaacaggagaaagtcaggagaataccgccttcattcagcagctgaatcgccagcatgttgatgtctttataaccacgacacgcgcccatcaactggcttttattctcaacaaacttcggcgggtccatcacgataacgtcaaatttttcaccgcgatcgcgataagtacgcagcaatttaaagacatcatcacggacaaactcagccttgctcagatccagtttgttcagctcaacgttctgccgtgcaatatccagcgcttcctgggaggtatcaacgctgacaacctggctgcaaccgcccatcagtgccgatacggcgaaaccaccggtataggagaaacagttcagcacacgtttattttcaacgtagcggcgggtagccaggcggctatcacgctggtccaggtagtagcccgttttgtgtccgtgctgaatatccaccagcagtttcattccgtgttcttcaatcggcagcagggcaggtggcaactcgccggtgacggggccctgggtcagctccattccttcttttttacgtaccgcgacgtcgctgcgatcgtaaatcgaacattccgggtacagcgtttgcagggcactaattaatgccgcgcgctgatattctgccccagcactcagcagttgcagcaccagaaaattaccgaaacgatcgatagtaatacccggcaggccatcagattctccggcgattaaacgatagctgtcgaggccatctttttgcgccagccagtcacgccatttttgtgcttgttgcaaacggcgggaaaaaaaagcaatgtcgatagactcagacgggtcaaacgtccagacgcgcgcccggatttgcgaagctggcgaataagcgccgcgtgctaaccattttccctgatgatcaacaatatcgatggtttcaccgaggctggctttaccttccatgcgggcaacggccccggaaaagacccacggatggcgacgaagtaatgatttttcgcgccctttggctaacactaaacgtacactcataatttacttttctgtcgatgcaaagaaatgggcgtcattgtccggagttttccatggatttgcaacgcgtccattaaggataaggagagcagcaatgtcgaaagtctgcataattgcctgggtttacgggcgagttcagggcgtaggatttcgctacaccacacagtacgaagcgaaaagactgggtttaaccgggtacgccaaaaatcttgacgatggcagcgtggaagtggttgcttgcggtgaagaagggcaggtggaaaaattaatgcagtggttaaagagtggcggcccgcgttctgcgcgtgtagaacgggtgctcagcgagccgcatcatccctcgggggaattaaccgattttcgtatccgttaaatacattttaccggttttggcaggccagcaattttggtggcttgcttagccggacctttcggaaacagtcggtataaatagcggctgttacctttttcttcgccaaatttattcgccatcgcttttaccagcatacgaatcgccggagaagtattgaattccagatagaaatcacgcacaaaacgcaccacttcccagtgttccggtgacagcgaaatcccttcgttctctgcaatcaccacagccagcggctcactccactggctgctttctttgagatagccttcggtatccgtttctatctctttaccttcgaagatcagcataattattactaccttaatcagactggcggcagtgtaacaaaaaacaaagccccgcataaagcgaggctatgaaagtgttagcgggtgagattaatcgcggctagcgaagcccagaatgctcagcaggctgacgaagatgttgtacagcgaaacatacaggctaaccgtggcacgaatatagttcgtctcaccgccatgaatgatgttgctggtttcaaacaagatagcgccagaggagatcagaatgaagaccgcgctgatcgccagatgcagagcaggcagctgcaggaagatattcgcaaccataccaatcagcaccaccacaatacccgccatcagcataccgccgaggaacgacatatctttgcgggtggtcagcacatatgcagagcagcagaagaacactaacgccgttccgcccagtgccatagcgattacgtcacccattccggcagacagataggtgttcagaataggtccgaggatataacccagaaaaccggtaaaggcgaatgcggagataatcccggtcggcttattcgccgttttataggtcaggaacatcaaaccatacatacccaccagcgtcagaatcagacccggagatggcagcatcagcaccgtactggcagttgcggtaatcgccgaaaaggccagcgtcaggctcagcagaaaataggtattacgcagcaccttatgggtgctaagcagtgatgtacggtcatgtgaagaactaacaatacgatccattgagtcactctctatgacagatgtaattaattaagcagcataatgataatgcgtaagggcacccagaagttttacccatctttacgcatttgatctggaacaggtttaacagcggattatcaggtcattaagcaaatataacgccctgagaatttcgacaggcaaaagaaaaaggggttagcatttagctaaccccttatcttatttggcggaagcgcagagattcgaactctggaaccctttcgggtcgccggttttcaagaccggtgccttcaaccgctcggccacacttccggaatgacgcgcactataaacatcccgatgcggcgtgtaaacccctaatttgtttgtttgcctgaaaaacagccaaaagtgcattgatagcgtgaaataacagcagattgatcatttcatcaccatgaattccttctcttttactcgtttagcaaccggctaaacatccccaccgcccggccaaaagaaaaataggtccatttttatcgctaaaagataaatccacacagtttgtattgttttgtgcaaaagtttcactacgctttattaacaatactttctggcgacgtgcgccagtgcagaaggatgagctttcgttttcagcatctcacgtgaagcgatggtttgccttgctacagggacgtcgcttgccgaccataagcgcccggtgtcctgccggtgtcgcaaggaggagagacgtgcgatatgaataacgaggaaacattttaccaggccatgcggcgtcagggcgttacccggcgcagctttctcaaatattgtagtctggctgccacgtcgctgggattaggcgcgggaatggcaccaaagattgcctgggcgctggagaacaaaccgcgcattccggtggtatggatccacggtctggaatgcacctgctgtaccgaatcttttatccgctccgctcacccactggcgaaggacgtcatcctttccctgatttccctcgattacgacgatactttgatggctgccgccggaacccaggcggaagaagtctttgaagacatcatcacgcaatacaatggcaaatatatcctcgcagtagaaggtaatccgccgctgggcgagcaggggatgttctgtatcagcagcggtcgaccgtttattgagaaactcaaacgtgccgctgccggagccagcgcgattatcgcctggggaacctgcgcgtcctggggctgcgtgcaggccgcgcgacccaatccgacgcaggcaacgcctatcgacaaagtcatcaccgacaaacccattatcaaagtacctggctgcccgccgatcccggatgtgatgagcgccatcattacttacatggtgacctttgatcgcttgccagatgtcgacagaatgggccgtccgctgatgttctatggtcagcgaatccacgataaatgctatcgccgcgcccacttcgacgccggagagttcgtccagagttgggatgatgacgctgcccgcaaaggttactgcctgtacaaaatgggctgcaaagggcctaccacctataacgcctgttcctccacacgctggaatgatggcgtttctttcccaatccagtctggtcacggctgcctgggctgtgcggaaaatggtttctgggatcgcggttcgttctacagccgcgtggtcgatattccgcaaatgggtactcattccaccgccgataccgtcggtttaaccgcgcttggcgtggtggcagcggctgttggtgtgcacgcagtcgccagcgccgttgaccagcgcagacgtcataaccagcaacctacagaaaccgaacatcagccaggcaatgaggataaacaggcatgagcactcagtacgaaactcagggatacaccatcaataatgccggacgccgcctggtggtcgacccgattacgcgcatcgaaggccacatgcgctgcgaagtgaatattaacgatcagaatgtgatcaccaatgccgtctcctgcggcaccatgtttcgcgggctggagatcatcctacaagggcgcgacccgcgcgatgcgtgggcgttcgttgaacgtatctgcggcgtctgtactggcgtacacgccctggcttcggtttacgccatcgaagatgctatcggtattaaagtgccggacaacgccaatatcatccgcaacattatgctggcaacgctctggtgccacgatcatctggtgcacttctatcagcttgccgggatggactggatcgatgtgttagatgcgctgaaagccgacccgcggaaaacctccgaactggcgcaaagtctctcctcttggccgaaatcatcccctggctatttcttcgacgtacaaaaccgcctgaaaaaatttgttgaaggcgggcagttggggatcttccgcaatggctactgggggcacccgcagtacaaactgccgccagaagctaacctgatgggctttgcccactatctcgaagctctcgatttccagcgtgaaattgtcaaaatccacgcggtctttggcggtaaaaacccgcatccaaactggattgtcggcgggatgccttgcgccatcaacattgacgaaagcggcgcggtcggggcagtcaatatggaacgcctgaacctggtgcagtcaattatcacccgcacggcggacttcattaacaacgtgatgatccccgacgccttagccatcggtcagttcaacaaaccgtggagcgaaatcggcactggtctttctgataaatgcgttctcagctacggcgcattcccggatattgccaacgactttggcgagaaaagtctgctgatgcctggcggcgcggtgattaacggcgacttcaacaatgtgctgccagtggatttggttgatccgcagcaggtgcaggagtttgtcgaccacgcctggtatcgatatcccaacgatcaggtcgggcgtcatccgttcgatggcatcaccgacccgtggtacaaccccggcgatgtcaaaggcagcgataccaacattcagcagctgaatgaacaggaacgctactcgtggatcaaagcgccacgctggcgcggtaacgcgatggaagtggggccgctggcgcgcacgttaatcgcttatcacaaaggcgatgctgcgaccgttgagtcggtcgatcgcatgatgtcggcgttgaacctgccgctttccggtatccagtcaacgttaggccgcattttgtgccgcgcgcacgaagcgcagtgggccgcaggtaagttgcagtatttcttcgacaagctgatgaccaacctgaaaaacggcaatctcgccactgcttccacggaaaaatgggaacctgcaacctggccgacagagtgccgtggtgtcggttttaccgaagcgccgcgcggggcgttaggccactgggccgccattcgcgatggcaagattgatctctaccagtgcgtggtgccgaccacctggaacgccagcccgcgcgatcccaaagggcagattggcgcttatgaagcggcgctgatgaacaccaaaatggcgatccccgagcaaccgctggagatcctgcgtactctgcacagctttgacccgtgcctcgcctgttcaacacacgtgctgggcgacgacggtagcgagctgatctccgtgcaggtgcgttaacagcgaaggagaatcatcatgcaacagaaaagcgacaacgttgtcagccactatgtctttgaagcgccagtgcgcatctggcactggttgacggtgttatgcatggcggtgttgatggtcaccggatactttatcggcaagccgctaccttccgtcagcggcgaggcgacgtatctgttctatatgggctacatcaggttaattcacttcagcgccgggatggtttttaccgtggttttgctgatgcggatctactgggcttttgttggcaatcgatactcccgcgagctgtttatcgtgccggtatggcgtaaaagctggtggcagggcgtgtggtatgaaatccgctggtatctgtttctggcaaaacgtccgagtgccgatataggccataatcccatcgcccaggcggcgatgttcggctatttcctgatgtcggtctttatgatcatcactggttttgcgctgtacagcgaacacagccagtacgctatttttgcgccgttccgttatgtggtggaatttttctactggacgggtggcaactcaatggacattcacagctggcatcggctggggatgtggctgattggcgcgtttgtgatcggtcatgtctacatggcgctgcgtgaagacatcatgtccgacgacacggtgatctccaccatggtcaacggctaccgtagccacaaatttggcaaaataagtaacaaggagcgttcatgagcgagcaacgcgtggtggtcatggggctgggcaacctgctgtgggccgatgaaggcttcggcgtgcgggtggcggaacggctgtatgcccattaccactggcccgagtatgtggagattgtcgatggcggtactcagggactgaacttgctggggtatgtcgaaagcgccagccatctgttgattctcgatgccattgactacgggctggaacctggaacgctgcgaacctatgccggagaacgcattccggcttatctcagcgcgaagaaaatgagcctgcatcagaacagtttctccgaagtgttggcgctggcggatatccgcggacatctgccagcacatattgccctcgtcggtctgcaacccgcaatgctcgacgactacggcggtagcctgagcgaactggcacgggagcaactgcccgctgcggaacaggcggcgctggcgcagcttgctgcgtggggaattgtgccgcaaccggctaatgaatcgcgctgtctcaattatgactgtctgtcgatggaaaattacgaaggcgttcgcttgcgccagtaccggatgacacaggaggagcagggatgagcaacgacacgccatttgatgcgttgtggcaacgaatgctggcgcgcggctggacgccagtcagtgaatcccgtcttgacgactggcttacgcaagcgccagacggcgtggtgttattaagcagtgacccgaaacgcacgccagaggtcagcgataatccggtaatgattggcgaattactgcgcgagtttcccgactatacatggcaggtggcgattgctgaccttgagcagagcgaagccatcggcgatcgctttggcgtctttcgctttcctgccactttagtgtttaccggcggaaactatcgcggcgtgctgaatggtattcacccgtgggcggaactgataaacctgatgcgcgggcttgtcgaaccgcagcaggagcgtgcctcatgagcgaaacttttttccatctgctggggccaggaacgcaaccgaacgatgacagtttcagcatgaatccactgccgatcacctgtcaggtgaatgatgaaccgagtatggcggccctggagcaatgtgctcacagcccgcaggtgattgcgctgttaaacgagttacaacatcaactaagcgaacgccaaccgccgttgggcgaggtgctggcagtcgatctgttaaatctcaacgccgacgatcgtcactttatcaatacgcttctcggggaaggggaagtgtcagtgcgcattcagcaggctgacgacagtgaaagtgaaatacaggaggcgatcttctgcggattatggcgggtgcgcagacgtcgcggcgaaaagttgctggaggacaaactggaggctggctgcgcgccgctggcgttgtggcaggcggcaacgcaaaatctcttgccgacagattcgctgttaccgccgcccattgatggcctgatgaatggcctaccgttggcgcatgagttactggcacatgtacgtaaccccgacgcgcagccgcacagcattaatctgacgcaattacccatcagcgaggctgatcggctttttctctcacgtctctgtgggccgggaaatattcagattcgtaccattggctatggcgagagctatatcaacgccacggggttacgccatgtctggcatttacgctgtacggacaccttaaaaggcccgttactggaaagttatgaaatctgcccaataccggaagtggtgctggcagcgccagaagatttggtcgactctgcgcagcggcttagcgaggtatgtcagtggctggcggaagctgcaccgacgtaaaaagacggtaagtatcgctttcagtcttatgaatatcgcaatcggcgaatacctctggtcgtagagtttcaggataaagagggagatctaccattatcgggttatttttctctcttcgcctacaggagtgcgcatgtgggatgtcattgatttatcgcgctggcagtttgctctgaccgcgctgtatcactttttatttgtaccccttaccctggggctgatttttttgctggctattatggaaaccatttacgtggtcaccggcaaaacaatctaccgcgatatgacgcgcttctggggtaagctcttcggtatcaattttgctcttggcgtggctaccggcctgaccatggagtttcagtttggtactaactggtcattctattccaactatgtgggcgatatttttggcgcaccgctggcgatggaagcattaatggccttcttcctcgaatccacctttgtcgggctgttcttcttcggctggcaacggctgaataaataccagcacctgctggtgacgtggctggtggcgttcggttcaaatctctctgcgttgtggatattgaatgccaacggttggatgcaatacccgaccggtgcgcattttgatatcgacaccctgcgtatggagatgaccagcttcagcgagctggtctttaatccggtcagccaggtgaaatttgtgcacaccgtaatggcgggctacgtgaccggggccatgtttattatggcgatcagcgcctggtatttactgcgcggacgggagcgcaatgtcgcattacgctcgtttgccatcggttccgtcttcggtactctggcgattatcggtaccctgcaactcggagacagttctgcgtatgaagtcgcgcaagtacaaccggtaaaactggcggcgatggaaggggagtggcaaacggaacctgcacctgcaccgttccatgtggttgcctggccggaacaggatcaagagcgtaacgcctttgccctcaaaattcccgcgctgctagggatcctcgccactcactcattagataaacccgtgccgggtctgaagaatttgatggctgaaacctacccacgcttgcaacgcggacgtatggcctggctgttaatgcaggaaatatcgcaaggcaatcgtgagccgcatgtgttgcaggcattccggggactggaaggtgacctgggctacggcatgttgctctcccgctatgcgccggatatgaatcatgtcacagccgcacagtaccaggcggcgatgcgtggcgcgatacctcaggttgcgccggtattctggagtttccgcatcatggtgggctgtggttccctgctgctactggtgatgctgattgcgcttgtccagacgctgcgtggcaaaatcgaccagcatcgctgggtgctgaaaatggcgctctggagtttgccgttgccgtggattgcgattgaagccgggtggtttatgaccgagtttggtcgtcagccgtgggcgatacaggacatcttaccgacatactccgcgcactccgctttaaccacaggacaactggctttctcactgatcatgatcgtagggctttacaccctgttcttaatcgccgaagtctacctgatgcagaaatatgcccgtctggggccgagcgcgatgcagagtgaacaaccgacgcagcaacaggggtaaaggagaaaatcatgtttgattatgaaacattgcgcttcatctggtggctgctgattggcgtgatcctggtggtctttatgatctccgacggatttgacatggggatcggctgtctgctgccgctggtggcgcgtaatgatgatgaacgccggatagtgataaacagcgttggtgcacactgggaaggcaaccaggtctggttgatcctcgctggtggggcattatttgccgcctggcccagagtgtatgcagcggcgttttccggcttttatgtggcgatgatcctggtgctgtgctcactgttcttccgcccgctggcctttgattatcgcggaaaaatcgccgatgcacgctggcgtaaaatgtgggacgccggtctggtcatcggcagtctggtgccgccggtagtcttcggtatcgccttcggcaacttgttgctcggcgtgccgtttgccttcacaccgcaattacgcgtggagtatctcggcagcttctggcaactgctgacgccattccctttattgtgcggattgctcagccttgggatggtgattttgcaaggtggcgtctggttacaactgaaaactgttggtgtgattcatctgcgttcacagctggcgaccaaacgcgctgcactgttggtgatgctgtgctttttgctggcgggttactggctgtgggtcggtattgatggctttgtactgctcgcccaggatgctaacggtccttccaatccgttaatgaaactggtggcagtgctacctggtgcctggatgaataattttgtcgagtcgcccgttttgtggatcttcccgctgctgggattcttctgcccattgctgacggtgatggcgatttatcgtggtcgcccgggttggggatttttgatggcatcattgatgcaatttggcgtgattttcacggcaggcatcacgctgttcccctttgtcatgccgtcaagcgtgagtccgatctccagcctgacgttgtgggacagtacttccagtcagctgacgctgagcattatgttggtaatcgtgctgatatttttgcccattgtgttgctctacactctctggagctactacaaaatgtgggggcgcatgacaacagaaactctccgccgtaacgaaaacgagttgtactaaggagcagaaacaatgtggtatttactttggttcgtcggcattttgttgatgtgttcgctctccacccttgtgttggtatggctggacccgcgtctgaaaagttaacgaacgtaggcctgatgcggcgcattagcatcgcatcaggcaatcaataatgtcagatatgaaaagcggaaacatatcgatgaaagcgatcttaatcccatttttatctcttctgattccgttaaccccgcaatctgcattcgctcagagtgagccggagctgaagctggaaagtgtggtgattgtcagtcgtcatggtgtgcgtgctccaaccaaggccacgcaactgatgcaggatgtcaccccagacgcatggccaacctggccggtaaaactgggttggctgacaccgcgcggtggtgagctaatcgcctatctcggacattaccaacgccagcgtctggtagccgacggattgctggcgaaaaagggctgcccgcagtctggtcaggtcgcgattattgctgatgtcgacgagcgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaacgtgactgacgcgatcctcagcagggcaggagggtcaattgctgactttaccgggcatcggcaaacggcgtttcgcgaactggaacgggtgcttaattttccgcaatcaaacttgtgccttaaacgtgagaaacaggacgaaagctgttcattaacgcaggcattaccatcggaactcaaggtgagcgccgacaatgtctcattaaccggtgcggtaagcctcgcatcaatgctgacggagatatttctcctgcaacaagcacagggaatgccggagccggggtggggaaggatcaccgattcacaccagtggaacaccttgctaagtttgcataacgcgcaattttatttgctacaacgcacgccagaggttgcccgcagccgcgccaccccgttattagatttgatcaagacagcgttgacgccccatccaccgcaaaaacaggcgtatggtgtgacattacccacttcagtgctgtttatcgccggacacgatactaatctggcaaatctcggcggcgcactggagctcaactggacgcttcccggtcagccggataacacgccgccaggtggtgaactggtgtttgaacgctggcgtcggctaagcgataacagccagtggattcaggtttcgctggtcttccagactttacagcagatgcgtgataaaacgccgctgtcattaaatacgccgcccggagaggtgaaactgaccctggcaggatgtgaagagcgaaatgcgcagggcatgtgttcgttggcaggttttacgcaaatcgtgaatgaagcacgcataccggcgtgcagtttgtaatgcataaaaaagagcattcagttacctgaatgctctgaggctgatgacaaacgaagaactgtctaatgcgtagaccggaaaaggcgttcacgccgcatccggccactttcagttttactctttctcggagtaactataaccgtaatagttatagccgtaactgtaagcggtgctggcgcgtttaatcacaccattgaggatagcgcctttaatattgacgcctgcctgttccagacgctgcattgacaaactcacctctttggcggtgttcaagccaaaacgcgcaaccagcaggctggtgccaacagaacgccccacgaccgcggcatcactcaccgccagcatcggcggcgtatcgacaatcaccagatcgtaatggtcgttcgcccattccagtaattgacgcatccgatcgcgcatcagcagttcagacgggttaggtggcacctgaccgcgagtaatcacatcaaagcctcctttgccaaaatgctggatcactttgttgagctcatctttacctgccagatattccgacaagccatgttcattactcacggtaaacaggttatgcgaataaccacggcgtaagtcggcatcaataaataacactttttgatcggactgggcgatcaccgctgccagagttgaactgacaaacgttttaccactgtctggcgtcgcaccggtgatcattagaatgttattctccgtctccatcatagcgaaatgcagactggttcgtagcgcacgtacggcttccacagcagaatccgccgggttatccaccgccaggaaggggatatttttagtacgatggcgctgctgattagaaaataaatttttcttacgcagacgggtgcgtttatccagccactcggacattgggatagtggcataaacgctgatgccgtgctcttccagttgttccggggcttctacaccacgacgcaacatcgcacgcgccagcacggcacccacagaaataaacaggccaagaataaaaccaagcaccacgttcaacgcttttttcggtttcactggctgcggctgagtgactgccgggtcgataatccgcacgttaccaatggcactggatttcgaaatactcaactcctgctggcggttaagtaattgcagatataccgcacggcccgcttctacgtcacgacttaaacgcaacacttcctgttgggtggaaggcattgccgatacccgcttattcaggcgtttgcgttcttgctccagcgtctggcgtttttccagcagcgcacgataagttgggtgatctttcttatacagctgggagatctctgcctcgcggaaggtcagctcattgagttgattatcaacgttcacaatctgctcaagaacggctttggcttccaggttaaggtcaaccgaatcgcgctgctggcgataaacgttgagtttttcttccgcttggtccagctcgctgcgcacttcaggtaactggcgctgtaagaattcaaggctttgtgaatcctgcgccgcctggcgagcgatattctgttgcaaatagttgttagcgatgctgttcagaatacgagtaatcaactggggatcatcaccagtcatggtaagttccagcatcccgctttctttactgcgttcgctaacggtaaaggtttcctgcaatgcgttaatcgcttccagttcggtacgctggctcaggacaaactgtgttcctggtttggccttaatgtccgcgatagtcagcgcaacgccatctttttccagacgctggccgaccataccattgacggtgaactcttcaccttccagtgtatagtggccgttttccccaaccgtgagtgtcagttgctgatcctgaccattcagttgtggaatatgcatccagctgatcgccagctcacctggtttttctttggttaatctcgcccagccgcgacccacaatcggaaaatacttctgctcaactatgtcgcgcagattcagttcagcaatggttttaccgagaatcatgcgcgattgcagcagttggatctccggtgcagactcgggcgatgagttagggatcatatcgctcaggccgctgagaatggcgttgccctgtttttgctcaacctggaccagagtatctgcctgataaattggtgtgcttaacagcgagtaagcgacagcgatcagcgtgaataacgcggtcacgctgataataaacttacggtgatcccataactcgccgaccagacgaagcagatcgatctcattttcctgagtgctgcctggtggcgtattcatatttttagttgtcatcgtattttataaactcaaattaccggctgaggcgcttcgcccattcctgactggcgcgctccaacataccgtagacatgttcaaatgcgtcctgacttttacgatagggatccgggatctctttctgttccagccattgcccaaacagcattgtcttcccgcggacctcgggagcaattgcggtaacctgagcaatatgttccgactccattgccagaatcagatcgtaatttcgtgccatctcagcagtgagcttacgtccggcatgtccttcaagagatacgccatgattagcggcaacatctgccgctgtcgcatctgcagggtgttttaccagaccatgaacacctgccgatttgacttttacgcccggcagacgtttacgcagcaagcgctcgccaatgggcgaacggcaaatgttgccggtacaaaccaccaggattgagttaaattttagttgggccatgtttgaatccaccgtgaagtctctgtcaggtcatgcaccccggaaatcgtcggtaccagcagagaaatcacacggttccaacgagccagcggcgcggtagtgacataaacaatgtcgtaaggttcaagctggaattccgttccgagtatcattgccgatgcgtccttcgcattcagctgataaatattggcgattttgccattctgcttgttttgcgttgcacgaataacaaaaatccccgtcgcatcagcgacatcctgattcataccctcagcgttacccagcgcttccgccagggtcataccgctgcggtccattttcagcgtgctctgtttacccacttcacccatcacgaagactttcagatcatcgttgcgcggaataaataaaatatcgcccgggtgcagcagtttgttctggcgcaagtcgccacgctgcatcagcgcatagaggttcactttggtctttacgccattctgggtgagcaccacgttgcgccagtctgcatctgcggtcagaccgcccgcggcgttaatcgcatccatgatggtcagaggaatattggtaatcggctgctgacccgatttgctgacttcgccggtgacgtacgctttttgcgatcggaacgccgcgacgctgacatcgacttgcgggctttcaatgactgaatcgagacgcgctgtaatctcgttgcgtacctgggtaagtgttttcccggccactttcaggcgaccaatataggggtagaaaatcgcaccatcggcgttaacccagttgccggtatcactggcgctacggtattgccctgcgggggtggttagttccgggtgatcccagaccgtaaccatcaacacatcaccaatcccgatacgatattcatagtttgcgatttgctgctccagctccgggttagcctgcgacataatcggtttggcgcgcaactgatcaatcaatcctggcgtgacgggatagatattgaccattttgtccaggtcatactgattgtcaggtagttcaatgacatccttgttactggtcgataaattctgaccaggaacaagggtacatgctgtcaaagacagaacagccaatgtcagtaccgaaaacttaaaaatgttctttttcattggtttatatttatcagtcaatgtaatgttatgaattacgtcaggttattgtccaaccggtacttctcgctctgccgtcattggatagagctggtatttgcgtgacagcatttgtccaccatcacgcgtcaatggtgtccacgaaaccaccgcgcggttgcggttaggtccaatggtcatcaagtcgaatggaatcgagatataaaaacctttactaaagccgccttcgccgtagtcatctttagatacgttactgattgccgcccatacccctaccgccacgccgctgtcaaagcgtttggcgacgtcgatcgttgcgcctttatcttttgccagatattgcccaacgctaagtttcatcagtacgccattgagcgtcggcgggttccagtaagccgtcacgaaacctgttggcgtggaataatcggtgaaacgcatcatgttgtcccagtcacgttgcttcacgtagttaacgtccacacccagcgcccagcaggcatctagcgggcgataaagcagctcggaaccgacaccggcgtacatcgtttccagataaccgccatacacctggccatagaaaccattgcctaagtcagcaaaatagttcgcctgcaagttgttgagataaacgtcattgcgaacgtagtcacggatatgcgtgcgcacgcggggcagggtagagtccgcgggcaacagcgaagacttaaacttgtcgtagttgttgtaaatattggtgaaaataccgccatcaagcagcaggtggtcggtaaaccagtagcgggcactggacatcagccccagctggaacatatagaaatcttccgggccgcccagcgactgtgaaagtgttgggttgaaagagtagctaaagcgatcttcacgaatacggtagccccgaccaaaggcagaaagatcttcagcttcaacacgttgttgttgcagtggctctgattgaccaggcgctgtacctgccagctgtttgcgcaggctggctacgtcggtttcggtagtcaccatcgccatatgctcgcgcttttgcgtcacgctaatcttctcaacgccttgcggcaggttattcaccagaatccggttggcacgatcgaccgcttcacgagagtcacggtatttgtattgctgaccagacatatacagtgtcttatcgcgtagctgaatttctggcgcgtcaaagcccgcgttatacttcagggcggtaagttggtttgctaccgtggtgtactgcaatccttcagattcaggcgcaggttgatatgccggttttggcgtatcgcgcagggcagggcgcagatcgttgaaattggtccgtaacgtgaagccaaacatcaacgtgttaccgcgttcataactcaggttgagatctgcccagctggcagcgcgataaactgcgccgacgttgaaatggcttgcctgaggcagtttgccagcgaaatcattctggtaattgtttccatcgtattcgagtttcagacgcaggggattccacggcgtttgatactcaatgccgccaaagatggaagccgggccacgaaagatatcgctaaagctgatatcgcccgcatcgtgagactctgcgcgatgacaatatttatcgctcacccggcaaaacgggttggtaatattgcccgcattaccggcgtagccccatgccatcccgagggtgaaatcaaatggccccgcttgcttgctggccaccagatactcaccgtcaaacagacccgtaccagcaatatcacgtttaccaaacgccacttgcggtagccagtaaccttcttcccacaggcgaagtttaaaatcgaatgatttgtctttgtatgactgatcgccgctgaaatcttcccactggctatatttgcgtgtgcgcacatccgtataacgaatggtgccttccagccatgggaacagcgccacggaggtggagtagaaccggtattgatcgttatcccggtagttgacgctgaattcaccttccggtgcgatgcgcgcatttggcatctgcaacaatcctgtgccgccaaagtctgattgcgacgaacccagcggatccgggtaggttaatacttcagcatgacaggcactggagacggcaatggccaggcagcttaaaagataagaattcttcttcatcagtcaggaacacgttgcgttaaaacagacacaatctggtcatttaaatcagcatatttttcgggcagtacatgcgcagaaaagcccaaccaaagctggctgccaggcggtggttccacatgtcttttattccacagggcaacaggggcgacgacagtctcaccctcaggcgtaatcaccataacgttattcttgtccgcgcctgcaaggcgggggtgatcttgcagataatcggtaacgctacggcctgcctgccagggcaattgcccggccccagaaaccgcacccagcagagtaatagtcaccggacgctgtacggtatagagcgtatagtccccgaccaacgggggattgctgttctcatccactcgtacaaaatcagggtccagtttgaccggtaagcgaccagtgatattgagattgagtaactgctggcgcacggatttaatcgttgccgccacatcgtcgtcagcttctgcttcccaggaagcaagctgtgccatgacatgttggtagtctttaagcgctttagctttcgccgcagagtcggtcagcaaggcaccaggccaccagaggcgatcgcgcagttgcggttgtgtcaccaactggacaacattttccacggggccaacggaaagtgtctgttgttcgccaggcagataaatagtcaccgttccttgcgcaaaggcatggggtgtcattacgtaaagtacgctggcaatgaaatacgactgtaatttattcatggtgcgggtttaagaaacgtcatttctacgggaataacccctgcgcctaacatttgccgactttgacgaacctggccagtagccgaatcgacccagaatgtgttttgccactgtttttctggccgcgtggaagtcacctcttcctgccagacattacacagcacattgcgacccgcaatattcagcgtctctaatccagcaaaggaaaaagtagaactcagggtcgcagagcgaaaatggttgtcttcactccagagaatatcgcgcgtccagcggctgccatcttttattgccagcgcgttacgcagagggtcctgcccggaatttgtcacttccagcagattattattaagtttgacggtttttaaaagacgtccattgtgggtaaccagcatggcgttatcctgggataaccatttgctttgttcttgttctatatatcccagtaccacaaagattcgttgcccttcattaaggcgtaaatacatagtggaataaggcaacgcctggatctgctgatccgctacggtgatatcctgattatcgaaaaggctggcgcgaaatgtatcgaccatactttgctggctgtgcgtacatcccgcaagaaatagtgcgaaaatcgataaaataagagggcgcacctttaatccttgaaaggttaattaaaaaaatgcaaatctctaaagcccggtacgaatatcgcaaccgggtatcatttaactttaatttcgacgcgttaaagcagtattagcgtgtagtggacgtggtggttgaggtgttatgagaaccgccatcgccactgtcatttgctgcaacaactgccaacgtcgccacaccaacagccgttgccacaccgacaactgtcgccgtgccgacagcgccagcagccacgccaccagtggtagtagcagtcgtggttgcgccggtagtggtcgttgtggtgccagtagtacccgtcgttgcctcggtcccgtttgttgcttcaggggcagcaaacgcagctggcgtcgtcaacatgaaggccataaggattgcagaaagcttgtgtttcataacttttcctttattcatcgcatggacaatacgggtgatgctgccaacttactgatttagtgtatgatggtgtttttgaggttctccagtggcttctgtttctatcagctgtccctcctgttcagctactgacggggtggtgcgtaacggcaaaagcactgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggtataacctgaatctgaggcagcacctggcacggctgggacggaagtcgctgtcgttctcaaaatcggtggagctgcatgacaaagtcatcgggcattatctgaacataaaacactatcaataagttggagtcattaccgacaatacgtacgcttgagatcaggattgtctactttgagtataacatccttgtgaaatctccctttcctcataccgcttgcactatatactgcgggtaggaaaggcgcgcagagggaaatataagattgttaactatccccctctggaaatacgacttgtgagcataagataaatcttagcaaaatacaaattaaagataaggaaattgttacgaaagctattaattattgttggtaatatagtttcaagtggtactataactggctgttaaatggcatttataactattaggtgcagagatattcgcttaaatggattagtttctttgtggaaaagtaactgatgttataatgtatgatgttgactatttcactattccaataaaaccagtcagctttaaacaagcagcgtcatattaagagagataaacatttgccgctgttggtcctcgcaggccatttacgcggcaaaattccacacgtaatcctggtataagcacttctgcgtcgcggggagtgaatgcggaaatatggacctgaacttctttacgaccgtcggaggggataatgaatcctttgccgcttttgcgatcaaaggttttgacaattcctgtcattttacgggacaaacaaattccttactgaaaatactgcgctgcactatacggggttaataaaataaagccagcgatatttaagaccgccggacggctaaaataaaatttgcttaatctcaattatcatgcgttaatagctgcgtcggtttgaaagacagacagcatacaaagtagtttactaaagcagttctcattatcaggcattatccccttcttttgagtctctctcctgaacactaagtagtttctgtattaaagccctgtttgccgaaaggcccaaaatgaaggaagtaaaatatgtctaataaaatgactggtttagtaaaatggtttaacgcagataaaggttttggctttatcactcctgatgatggcagcaaagacgttttcgtccatttcaccgccatccagagcaatgaattccgcacgctgaacgaaaatcagaaagttgaattttctattgagcaggggcaacgtggccccgcggcagcgaacgttgttacgctctaaggttgccattattactcaacatctccatttccgctgtccatgttgtcatggttcacagtaccgcacatcggcattcgatgtgacggagcgaaaccctttgggcgctaagtgtattttttgtaaatcgacgatgatcacctttgataacgtcgcgctgcaaatacgcactgaccatgcgccgctggatttcacaaaataatatcaggctccctcgtggagccttttttatatctgccttatttttcttcaacgctgtatgtatagtaagcgataacctgttgattattgaatctttcggggagatggcttataacatttcttacctgaccagggtaccgggaaccaacaccttactggcgtgttgctgtcttttaagaccagaagaggttaacagtgaatattgaagagttaaaaaaacaagccgaaacggaaatcgccgactttatcgcgcaaaaaatcgccgagctgaacaagaatacagggaaagaagtctctgaaattcgcttcaccgcacgagaaaaaatgaccgggcttgaaagttatgatgtcaaaatcaaaataatgtgattttgtgaacatcaccccgtgcgaggtgatgttccgcttgttgctaatttagtgaccaatcattggcgcttgtggaattaagcgtcggtacaattcctccggcaccgggctttgccatactcccgcatacattgcgtaaccaatcaccgcaaacataatccccagaaccagtagcgtcattaaccagccagacaacgcaaaggcttttttatttgccgcaggtttttgcagtgaaaaggtcaatgttgaggctaccggacatgactctacgcaagtcatacagccggtacattccactgttcgtacctgaattaatttatcgaccgggatccgtgatgggcaattttttgcgcatttgccacagtcgatacaactttcggcattgcgacgaatcttaaacggcgacaatagcgaaaccacgcccatcagcgcgccatatgggcaaagataacgacaccaggcatggcgaataaacaggctggcaatcagcaaaacggtcacgctgattaatgtcgcggtccccatatgacgaaagaaatcgagcattttaacgtccatcaccacgctgtagggcgacaacataaaatagtgaatcgcctgagcgggcatcaataacgcgatatagataaaaaaactcaacagcaaatacttcacgccgcgcagaggaatatccagccagcggggaaggacacattgccgaccaaacagtttgttaccgagatcgccgattaattcagaaagcgtaccaaccgggcataaccatgagcaaaaggcctttttgagtaatagactgatgacgataaaagcgaccaataacagcatcgcggcggcgtggacggacggtaactgacctgttacaaggctatatttcagattcatcagcccggcaatcggtagccagccttcgatacctcccggtctggcgacaaatgtcgtgctacttgccgtttcgtaatagcgcacccaataccagaacgtgatggcaatataaatattcattgccaacagtaataattgcgtcgctttacgccaggtcgtggcattacgccagtcattccacggtaatttgccgcccgtcgtgcctggccgccgctgccagcgggttcttttattctctgccatgattttgccagtccgttaagttgtataccaaatgccactattctagttgttcttaactggctgatattgattcaaatcgcgttcaggtctttcttatgcaaccatgcttccagagcggcaacactgcgtgtaatttcttcgtgtggaaggggggcagataatggctgctgctccagttgtgcgcatagctggctggcgatatgcattcccagactcgagcaactgctttttagctgatgcgcggcacgctttattttctcgctatcctgactggcgcgggcaatgtcgatttcatcgagaagcggcagggcatgttgtgtaaataataccagccattcgtggatcttctccgtccccattaactgagcatcttcattgagttgcgatacatccagcgattgatcattattgacttgcagttggagatagtgcgccagtaactgaccgagcacttcacgcggcaccggtttagggataatcccgcggaataatgaactggtacgctggcgcagcgtttcgtcaatgacatgggcgctaaagccaatcaaaaccagcgacggatattgctgtgccagttgtcgggcaagcgtaatgccgtcgatatccggcagatcaaaatccaccagtgcggcagcaaacggttcgctattttgcagtgtctctaaagcctgcgcggcattgccaacagcaacaatctgcgcaccactggttttcagcatctcaatggtaattcgctgggttagcgggttatcttcaattaacagcaaacgtaaaccgtcaagacgcaccgcctgattgactgtttttggcacgggtgccgtggcaacacgtaacggcaagcgtaaacaaaaacagcttccaacctccggcgtgctggtggcgctcagttcgccgcccatcgcctgggccagacggctactgatagtcagtcccagcccggtgccgccgcgtttgccgcttacctgcacaaatggctggaagatttctgccagtttcgcgggatcaataccgcagccgctgtcttccacttcgaccagccattgctcgccatcagtgcgactacgcaggataatgtacccttcgtcagtaaaacgcagggcgttgctcaacaggttggttataacctgacgaatacgtcgtggatcgcccattaacgcgcacggcatatcatcggcaattgccgttgccaggcgaatcgggcgacctttcacccgtccgctcattaattgcagggtactttccagcagcgggcgcggttcaaagggctcatcgctgaccgaaacattcttgccacctgcttcgatagcggaataatcgagaatatcgttgaggatggtcagcaacgattcaccagagtcagtaattgcccgcaaatcatcacgctgggcgttaagtgcggggttatctgccagcagttgagcagtgccgagaataccgtacagcggtgtgcggatctcatggctcatcgccgccagaaacgccgattttgcctggctggctttttctgcttccgcccgtgcctgtcggtgttctatcaccagttcctgcaattcagctgtacgcgctttgacctgcgccgccagctgttcgcggtggcgattcagtgcatgaacattgctgcgaaacgcatccatcagccgcccgatggtatccagctcccgtacgccagcggtttccgggaaaggggagtcaatatcaccgtccagcagccgttgcagcgcctgcgtttgttcggcaagtggacgcgtgactgagcgataaaccacgcgccagaggatcagaatcagtgcgcaaagtgaaaccatccccagcaataacaggctgtattgcccgcgtgcactcgctttttccagatgcgccagtccgtgctgattacgcagctcaatggtgtcgaccagctgactgacttcgctactaaactgcgcgaactgggcgatgttattttgtgcgagagtttgtaggtgattgctgatttcactgtcctgctgatacagcgccagcaaatcgctatattggctaacggtagttaacgttgttgcgacctgcgcacgaacacccggatcttcaatgcgtatttgccgacgttgcagaattttcaccgcattattgagctgcttttccagcgttggtgcatttttctggatctgctccagccccagattcatcaccatttgctgcacccgcagagcgctaaggcgcagttcattcatctggttaacatactcaagatcgatatcaatcagccgatcgagtgcactttcagcagcctgacgctgatcttgttcgatcaaatcgtaaatcccggcctgggtcgctccagcggaagttgtcgcattattcgcctgaccttgcgccaggcgtgcgatctcatcggcggcagcgactatctgctgactgagttgctgttgttgctggcgcagttgcaaacgctgccccaccagttccccttgctgacgtaacgaacgggagatctcctgctcctgttgttcaatagcggtggtatcaaaaccttgttcccgtaacgcttgcagcaacgcattaatcttcaggctttgtgcggtgagcattcgcccctgcgcctgccacatcttttcgttatcggcactggtcaggttctgcgcggcgaaaagttcccaggcgctggcttcgctcaactggcgcgccatattcatggtaggaatcaatgcctgagtgttgtctttttccacctggctgataaagcgcaggttgtaccatcccaccagggtactggtcagggttaacagcgccatcagggcaaagcccatccagagtcttcgggtcagggttaaattcacggtcggtgcactttaggtgaaaaaggttgagtcgcaaagcggaatgcatctagcataaagccttattattgatgaggctatcatgcgcgtactgctatttttacttctttcccttttcatgttgccggcattttcggctgataacctgttgcgctggcatgatgcgcagcatttcacggtgcaagcctctacgccgcttaaagccaaacgcgcatggaaactgtgcgcgctttatcccagcctgaaagattcatattggttatcgttgaactatggtatgcaggaggctgctcgccgctacggtgtggatttaaaagtgctggaggcaggcggctacagccagttggctacccagcaagcacaaatcgaccagtgtaaacagtggggcgcagaggccattttgctcggtagtagcacgacctcatttcccgacctgcaaaagcaggtagcaagtctgccggtgatcgaactggtaaatgctattgatgctccccaggtgaaaagccgcgttggtgtgccctggtttcagatgggctatcaaccggggcgatatctggtgcaatgggcgcacggtaaaccactgaatgtgctgttgatgcccggacccgataacgccgggggcagtaaggagatggtcgagggttttcgcgcagccattgccggaagcccggtgcgtattgttgatattgcgcttggtgataacgatattgaaatccagcgtaacctgttgcaggagatgctggaacgccatccagaaatcgacgtcgttgccggaacggccattgcggcagaggcggcaatgggggaagggcgtaacctgaaaacgccgcttaccgtggtgtcgttttatctttcacatcaggtgtatcgcgggctgaagcggggaagagtgattatggctgccagcgatcaaatggtctggcagggggaactggcggttgagcaggccatcaggcaattacaggggcaatcggtttctgataatgtcagcccaccgattttagttctgacgccgaaaaatgccgaccgtgaacatattcgccgctcgctgtcaccagggggatttcgtccggtctatttttatcagcacacatcagcggctaagaaataaccttcaccatgttgcgtcaccagtaaatccgcgctgagtttatgacgtaaacgacgaattaacacatcgacggtgcgcaggtcagggttttccacccgacgcgcagaaagcatacgtagcagacgttcacggctgagaatttcgcccggattcgtcacaaatgccaccaacatttcatactctgcgcgggtcagtttaatcggctcgccatcccgctccagcgtatggcgcgacacattcaggcaataaccggcaaagcgatagcagttgtcctgagtgtgcggttgagcttgtcgcgcgaggtcgattcgccagagcagatttttcacccgtactaccagttcgcgcagttccagcggtttggtgacgtaatcgtctgcgcccatttccagcccaacaatacggtcaatccgatcgctgcgtccggtaaccagaataatccccaccgttgagcgttctcgcagggcgcgggttaacatcaggccattttcatcgggtaagttgatatccagcagaattaaatctaccgactgattctgcataatttcccgtagcccagcaccgctcgccgtaacggaaacggtatacccctcctgagtgaagtaggattgtaatcgcgcctgggtaaccggctcatcttcaacaataacaatgtgatgtggcatcagagggttttactcattctgttcatatctgttcatattctgccgtaagccgttcatcctgaccagtgccgctgttcatatttgctcattaagatcgcttcactaaaccataattctacaggggttattatgcggaaactctggaacgcgctacgccgacccagtgctcgttggtcggtactggcgctggtcgcaattgggattgtgattggcattgcgctgattgtattgccacacgttgggatcaaagtcaccagcacaaccgaattttgtgtcagttgccacagtatgcaaccggtgtatgaagaatataaacagtcggtgcatttccagaacgcctccggcgtgcgagctgaatgccatgactgtcatatcccgccggatattccaggcatggtgaagcgcaaactggaagcgagcaatgatatctaccagacctttattgctcactccattgatacacctgaaaaattcgaagccaaacgcgcggaacttgccgagcgtgaatgggcgcgaatgaaagaaaacaactcggcaacctgccgctcctgccataactacgatgcgatggatcatgcgaagcagcatcctgaagcagcacgtcagatgaaggtggcagcgaaagataatcaatcctgcatcgactgtcataaaggtattgcccaccagttaccggatatgagtagcggcttccgtaagcagttcgatgagctgcgcgccagtgctaatgacagtggtgacacgctgtactctattgatattaagccaatttatgcggcgaaaggcgataaagaagcctctggttctctgctgcctgcttcggaagtgaaagtccttaaacgtgacggcgactggctgcaaattgaaattaccggctggacggaaagcgccggacgtcagcgtgtactcacccaattcccaggtaaacgcatctttgttgcctcgattcgtggtgatgtgcagcagcaggtaaaaacgctggagaaaaccaccgttgccgacaccaataccgagtggagcaagttgcaggccactgcgtggatgaagaaaggcgacatggtgaacgatatcaaaccgatctgggcttatgcggattcgttgtacaacggcacctgtaaccagtgccacggcgcaccggaaatcgcccactttgacgctaacggttggatcggcacgctcaacggcatgattggctttaccagtctcgataaacgtgaagaacgcaccttgttgaaatatctgcaaatgaatgcgtctgacaccgcaggtaaggctcacggcgataagaaggaagaaaaataatgaacaataacgatctctttcaggcatcacgtcggcgttttctggcacaactcggcggcttaaccgtcgccgggatgctggggccgtcattgttaacgccgcgacgtgcgactgcggcgcaagcggcgactgacgctgtcatctcgaaagagggcattcttaccgggtcgcactggggggctatccgcgcgacggtgaaggatggtcgctttgtggcggcaaaaccgttcgaactggataaatatccgtcgaaaatgattgccggattgccggatcacgtacacaacgcggcgcgtattcgttatccgatggtacgcgtggactggctgcgtaagcgccatctcagcgatacctcccagcgcggtgataaccgttttgtgcgcgtgagctgggatgaagccctcgacatgttctatgaagaactggaacgcgtgcagaaaactcacgggccgagtgccttgctgaccgccagtggttggcaatcgacggggatgttccataacgcttcggggatgctggcgaaagctattgccttgcatggtaatagcgttggtacgggcggagattactctaccggtgctgcgcaggtgatcctgccgcgcgtagtcggttcgatggaagtgtatgaacagcaaacctcctggccgctggtattgcagaacagcaaaaccattgtgctgtggggctccgatttgctgaaaaaccagcaagcgaactggtggtgcccggatcacgatgtttatgaatattacgcgcagctaaaagcgaaagtcgccgccggtgaaattgaggtcatcagcatcgatccggttgtcacatccacccatgagtatctggggcgcgagcatgtgaagcacattgcggttaacccgcaaactgacgtgccgctgcaactggcgctggcacatacgctgtacagtgaaaacctgtacgacaaaaacttccttgctaactactgtgtgggttttgagcagttcctgccgtatctgctgggtgagaaagacggtcagccgaaagatgccgcatgggctgaaaaactgaccggcattgatgccgaaaccattcgtgggctggcgcggcagatggcggcgaacagaacgcaaattattgctggctggtgcgtgcagcgtatgcagcacggtgaacagtgggcgtggatgattgtggttctggcggcgatgctggggcaaattggcctgccaggtggtggttttggttttggctggcactacaacggcgcaggcacgccggggcgtaaaggcgttattctgagtggtttctccggctctacgtcgattccgcctgttcacgacaacagtgactacaaaggctacagcagcactattccgattgcccgttttatcgatgcgatcctcgaaccggggaaagtgatcaactggaacggtaaatcggtaaaactgccgccgctgaaaatgtgtatttttgccggaactaacccattccatcgccatcagcagatcaaccgcattattgaaggcttgcgcaagctggaaacggttatcgccatagataaccagtggacctcaacctgccgctttgccgatatcgtactgcctgcgaccacgcagtttgagcgtaacgatctcgaccagtacggcaatcactccaaccgtggcattatcgccatgaaacaggtggtgccgccgcagttcgaggcgcgcaacgacttcgatattttccgcgagctgtgccgtcgctttaatcgcgaagaagcctttaccgaagggctggacgaaatgggctggctgaaacgcatctggcaggaaggtgtacagcaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcgaaaactatcgccgatatgaactacgacgattgtcaggggcatccgatgtggtttgagaaaatcgaacgctcccacggtgggcctggctcgcaaaagtatccgttgcatctgcaatctgtgcatccggatttccgacttcactcgcagttatgtgagtcggaaacgctgcgtcagcaatatacggtagcgggtaaagagccagtattcattaacccgcaggatgccagcgcgcgcggtattcgtaacggtgatgtggtacgcgtctttaacgctcgcggtcaggtgttggcaggggcagtggtttctgaccgctatgcacccggcgtggcacgaattcacgaaggggcatggtacgatccagataaaggcggcgagcctggtgcgctgtgcaaatacggtaaccccaacgtgttgaccatcgacatcggtacatcgcagctggcgcaggcgaccagtgcgcacactacgctggtggaaattgagaagtacaacggaacagtggagcaggtgacggcgtttaacggccccgtggagatggtggcgcagtgcgaatatgttcccgcgtcgcaggtgaaatcatgaccacgctgacagcacaacagattgcctgtgtttacgcctggctagcgcagttgttctcccgtgagctggacgatgaacaactgacgcaaatcgccagtgcgcagatggctgaatggttttcgttgctgaaaagcgaaccgccgctcactgcggcggtgaacgagctggaaaaccgtattgccacgctgacagtacgtgacgatgcccgtctggaactggccgcggacttttgcggcctgtttctgatgaccgacaaacaagcggcgctgccgtatgcatcggcctacaaacaggacgagcaagagattaaacgcttgttagttgaggcagggatggaaaccagcggcaatttcaacgaaccggcagatcatctggcgatctatctcgaattgctcagccatctgcatttttcgctgggagaggggaccgttcctgcgcgaagaatcgacagtttgcggcaaaaaacactgacggcgctgtggcaatggttaccagagtttgttgcgcgttgtcgtcagtatgacagctttggtttttacgcggcactaagccagttattgctggtgttagtggagtgcgaccaccaaaacagataacgtcgtttgtgcgcctgaaaagacgcgtttagcgtcgcatcaggcattatggcgcagttgccggatgcggcgtgaacgtcttatccggcccacaggaactgtaatctttgtagaccggttaagatgcgtcatcgcatccggcaaacacacatcacggatgagctacaaaccgggaaagccgctggcgcagcaggcggttttcctgcttcaggtgcgcaatatcatccattaacgtcagcgccaccgcgatccccggccagtccagagccagttcatgacgcaggcgtaccgcgcgttgcaccacaatggcggcatggtcgtcaaatacccaggttgtttcctggatctcacgcggttcaaccacccccaaaccgacaatttcattcaactcctcttcagagatgccggtatgcaggcaaaattcggtaatagtaaaagtcaccgtaacattagccattatgctttcccccaatctttacgtggatcaaaagacgactgggcgtctgccagttgctgccacagcgcggcagtgttttcatccggtttcggcggcatcacgattttcagtaccgcatacagatcgccggtctgttttttgctcaccagacctttgcctttaacgcgcaatcgttgcccggcctggctgcctggcgggatagtcagcaaaatgctttctttcagtgttggaacggtgactttagcacccagcgccgcttcccacgggctaaccggcaccacaatttccagatcctggccgacaatatcaaacagcggatgtggcgcaatatgaatcaccagccacaaatcgccatttggaccgccgttttcgcccggcgtcccctggcctttcagacggatgcgttgaccattgccgacgcccgccgggatcttcacattcagcgttttcggaatttcctgttcgatcatgccaaaggcgttataaaccggcaggttatagctgatggtacgcttatgctcagtaagcgtttcttcgaggaataccgccacttcgatttcaatatcgtggccgcgtgtggcggggcgttgacggctctggcgggcatgctgaccgaaaattgacgagaagatatcgtcaaaatcttcggcgttaaaactctgaccgtcgccatggtggaactgacggttaaattgcggatcgttgcgatgttgccacatctgatcatactcagcgcgacgttgttcatcacttaacacttcccaggcttcagcgacctctttgaagcgggcttcggcatccggttctttgctgacatcaggatggtatttgcgggcaagtcgacgataggcggtcttgattgtcttgagatcgtccgtcggtttcacgcccatgatggcgtaataatcctttaattccatagcgttatctcgcgtaaatcaacacaaattgaaggaacccctgtaaggtaactcctataagtgtagggtaatcctcaaaatttcatatgccaacacagaatatgttattgaaatcatcgcggagaggaggtcgccatcaagatgggttgctgaacatattttaaacaggtgaaaaagggtgagcgatttttgatagttgaaccaggcactttaagtttaactagggcgtcattatttattaaattttatagacgctatatatgggtagtaatatacatggaattagttgcactgcaaataattatttgaaacaggcctggaacgatataaaaaatgagtacgaaaaaaatcaaacatattcaatcacgctttttgaaaacacactggtgtgttttatgcggttatacaatgaactcagacgtaaagtaaatgaagaggatactccatgtctggaatgtgaatcactagaaaaagaatttgaggaaatgcagaatgataatgatctatcattatttatgagaatattgcgtactaatgatacacaaatttattcaggggtttcaggaggtattacatatactatacaatatgttcgagatattgatattgttagagtgtccttgccgggcagagcttcagagtctatcacagattttaaaggttattattggtataactttatggagtatattgaaaacattaatgcgtgtgatgatgttttttctgagtattgttttgatgatgaaaatataagtgtccagccagagcggataaatacgccgggaatatctgatttggattctgacattgatttgtctggtatatcttttattcagcgtgaaactaaccaggcattaggattaaaatatgctcctgtagatggcgatggatattgtctgttaagagctatactggttttaaaacaacatgattattcatgggcgctggtcagttataagatgcaaaaggaagtttacaacgaattcattaaaatggttgataaaaaaacgatcgaggctcttgttgatacggcattctataatctcagggaagatgtaaagacgttatttggcgttgatctacaatctgacaaccaaattcaggggcagagtagtcttatgtcatggagctttctgttttttaaaaaacaattcattgatagttgcttgaataacgaaaaatgtatcctgcatttacccgagtttatatttaatgataacaagaacttgcttgctttagataccgacacgtcggataggattaaagcggtgaagaattttcttgttgttctttcagatagcatttgctcattatttattgttaatagtaatgtggcatcaatctccttggggaatgaatccttttcaacagatgaagatcttgagtatggttatttaatgaacactggcaatcattatgacgtttacctccctcctgaactttttgctcaggcttacaagttaaacaataaggaaatgaatgcgcaactcgactatttaaatcgttatgcaatttaatggcaaaggcatatgctaaaaaccattgttattagtctcacacttttttattggtaaatattgtctctgtattggtaacgccgcagatattctgtttagccacaggtgcaattatcagcggcgtacgcgaggcaggggctaatcaggcatagtttgcgtcaaaccttgcctgtttttgaagatgtatatagaaaaacaggcgttcaacaagccattttgcgaacctgttcccggaaaaaagtcatatttctgtcacactctttagtgattgataacaaaagaggtgccaggaatgaacaaaacgctaatcgccgcagctgtggcagggatagttttactcgcttcaaacgctcaggcacaaaccgtaccggaaggctatcagctacagcaagtgctcatgatgagccgccataacttacgtgcgccgctggcgaacaatggcagtgtgctggagcagtcgacgccgaataaatggccagaatgggacgtccccggtgggcaactcaccaccaaaggtggcgtgctcgaagtgtatatgggccattacatgcgtgaatggctggcagagcaggggatggtgaaatcgggggaatgcccgccgccgtacaccgtttatgcctatgccaatagtctgcaacgtaccgttgcgaccgcacagttctttattaccggcgcattcccggggtgtgatattcctgtgcatcaccaggaaaaaatgggcactatggacccaacctttaacccggtgatcaccgatgattccgccgcattcagtgaacaggcggtggcggcaatggagaaagagctcagcaaactccagcttaccgacagctaccagctactggaaaaaatcgttaactataaagattcccctgcctgtaaagagaaacaacagtgttcgctggtggatggcaaaaatacctttagcgccaagtatcaacaagaaccaggtgtttccgggccgctgaaagtcggcaactcgctggtagatgcgtttactttgcaatattacgaaggttttccgatggatcaggtggcctggggagaaatcaaatctgaccagcagtggaaggtgttgtcgaagcttaaaaacggctaccaggacagcctgtttacctcaccggaagtggcgcgcaatgttgcgaaaccgctggtcagttatatcgacaaagctctggtcaccgatcgcaccagcgcaccgaaaattacagtgttggttgggcacgactccaacattgcctctctgttaacggcgctggatttcaaaccgtatcagttgcatgaccagaacgaacgcacgccgattggcggcaaaatcgttttccagcgttggcatgacagcaaagccaatcgcgatttgatgaaaattgaatatgtgtatcagagtgcggaacagttacgtaatgccgatgcgttaaccctgcaggcacctgcgcagcgtgtgacgctggaattaagcggttgcccgatagacgctgatggtttctgcccgatggataagtttgatagcgtgttgaatgaagcggtgaaataacagaaaactcccccgcgagaagcgggggagtcgctggttaaacgtttttacgttcgatggtctgttcgccccaaaaaagcgaatctttatcggtcttagcaaaggctttgactaacacttcatcactaccttcttcccaaatcttttccgccattttttcgtcgtacccggcgacttcgaaaatggcctcggctatttccggcgacgtattgcgcagagatgcccattcaccgacgtgatgagctttcgcttcttgagttggcatgcgtatcctcctgttgaagattagccgttaagtttaactgccagacctgcgacatattccccttgataacgagcaatagacagttcttcctggctgggctggcgtgaaccgtcaccgcctgcgatggtggttgcgccgtacggcgtaccgccgcgaacctgtgaaacgtcaaataattcctgcgctgcgtagccaatagggacaattaccatgccgtgatgcgcaagggtcgtccaggtggatgtgatggtttgttcctgaccgccgccagtaccggtggaactaaagacgctcgccagttttccgtatagtgcgccggaagcccacaggccgcccgtctggtcgaggaaggtacgcatttgaccggacatgttgccaaagcgggtaggtgtaccaaaaataatggcgtcgtaatcggccagttcttgcggggttgcaaccggtgcagtttgcgttttaccgcctgctttttcaaataattgcggcggcatggtttccggtacacgcttaacgacaacttcagcgccatccactttgcttgcaccctcagcgactgcgcgtgccatcgtttcaatatgtccgtacatggaataataaagcaccagaactttagccatttctaaccactcctcgtgttatctctattccgtagcgattcgctaccacttatttaaagataagacgtccttttcagagtgcaaatttcacaaccacttatttgatttataacaactttcacaagcacgtaattttgtcgcaaaatgacacatttttatctcatcgcgtttttttaatcataagagcggcttatggataattattggagatgatatctattctcgctaagaagctgttgcaggatattaccaaacgcgggtctgcccgcgtcagttcactaagcttagtcccacgtagcgaaaatatggcagccgccatacgccgcgttaattctatgcaatatgatgtctatacccagacggaggtcagtaatggcaaaccatcgaggcggttccggcaattttgcagaagaccgcgaaagagcatcagaagcaggtaaaaaaggtggacagcacagcgggggtaatttcaagaatgacccgcagcgcgcatctgaagcaggtaaaaaaggtggtaagagcagtcacggcaaaagcgacaactagccgggctaatcaatgacgaatgcatttttgtctgtagctcgtcaaaaagccatcaccgccggttacccggtggttgatactgatgacaaatgtaagcttgcctgatgcgcgatgcttatcaggcctaccagaagattgcaatatattgaatttgcactgttttgtaggccggataaggcgtttacgccgcatccggcatgaacaatgcgtacgttgtcaacaatctgcaccgccggtaaccccggcggttttctgtttatggctcctgatgaacaacttctggcggtggaacgtcaaccaactttctgcttaacaacgcattgagtaaaatcgcgccaaaggttgctgtaccaatccctcccaacgtaaaaccgcccagcgtgagagcaaaatcacccgcgcccagcactaaggttactgcgaccataatcaaattaccgttctggcttaaatcgacacggttttgtacccatatccttgcgcctgcgacggcaatcagcccgaacacaacaattgatgcaccaccaataaccgcggccggaatggtatgaatcagcgcaccaaatttcggtgaaaagcccaacagcatggcgatgacggcagcagcaacaaacaccagcgtcgagtagactttggtcacggccatcacaccgatattttcagcataggtggtcacgccgctaccgccgacagagccggaaagcatcgttgccagaccatcgcctacgaatgcccgccccatatacgggtccatattgcgtccggtcatcccggcgactgccttgagatgacctaagttttccgccaccagaatcaccgccacgggcgcaatcagcatcattgcctgaccattaaaagcaggagtggaaaaatgtggcagaccgaaccaggcagcatggctgacgagagtaaaatcgacggcttttcccagccctaaaacgttggtcatcacgccatacagcagacaggcgacaattaatcctacgagaatcaataaccgctggatcatgccacgggtaaacaccgccaccagcccaatacacagcaccgtcattaccgccatccagctatcaaaggccgaagccgatacacttttcactgcgataggcgctaagttcaggccaatcgccatcaccaccgcacccgtcaccaccggcggcatcagtcgttcaatccagcgcgtaccgattttcatcaccaccaggccaatgacggtataaaccagcccacaggcgataatcccgcccagcgcaatgctgatattcgggttaatgccctgaccgttaaagcccgtcgcggcgatcaccacgccgacaaaagccgcgctggagccgagataactggggacgcgcccgccggtaataaagaaaaacagtaacgtgccgatccccgacattaaaatggaaagattgggatccagccccatcagaatcggcattaacaccgtcgcgccaaacatcgccaccgcgtgttgaacgcccattactgccgtctgagcaaacggcaatcgttcatccggcgcgaccacgccgctctctgtagaggtcgattttaactgccagtgaggaaaaccgaacattgccatcagctgtctccttaaggaggttaacaagcagggcgcatcagcgcgtgataactgcgatcgaaccacaccagcccgtagggtgtggtgtgacgatgaatcgcttcgatggcgcaaaacagaatgtcgtgggtgccgacgctcaccacctggctgatacggcagtcaaacgaaaccagagcctcttccagttgcgggcatccggtcacccccgtctgccagcgggcggcggcaaagcggtgttccatgggcgttttgccgccaaaaaggtttgaaagcggctcctgcccggcgctaagtgtatttacacacagcgttcgattttcattgaatgccggccagacggacgccccacgattcaggcacaccagtaatgtgggcggcgtatcggtcacactgcagacggcgctggcggtgaacccggcgcgcccggctggaccgtccgtggtgataatattgaccgccgcgcccatgcaggacatcgcatcgcgaaaagtttgttgatcgacaatgttcatagtttgctccttacaacagcccgcaggcttcttcaaaggacagacgtggcaggcgcgcataaagcttgctgctatcgccatagccgatattaatcagcagattgctcttcagcgtgctgcccgtaaaaaaggcgtcgtccacgtgttgacggtcaaagcccgacatcgggccggtatccagtcccagcgcccggcaggcgacgatcagataggccgcctgcatggaactgttgcgaaacgctgtttcttcggcaagttgtgggctggaggtaaaccaactgcgggcatcaccgtggggaaacagtagtggtaaccgttcataaaattcactgtcccaggcgacgatagcggtgacgggcgcggtcagggttttttgcagattgccgctggaaagtgccgggcgcagacgttcttttccttctgccgtgcgggtaaacacgatccgtgccggagaacagttagctgatgtcggcccccatttcatcagggcataaatctcccgtaacgtctcatcgctgacgggtgtctcccgccagccgttgtgagtgcgggcatcggtgaacagggtgctaagcgcacctgggctaacggcttcgttcatagcaattccttacagggcggcttcacggtgatgtaacaggctggcaagcccgttgagtaacagagcattaaacgtttcgggatcggtcacgttgcaggcgtgtccgccatagggcatcaccattttctggctatcgggcagggcggcatgaagttcactggaacatgctgttggcaccagcagatcatcactggcgcagatgatttgcaccgggcagcggatgcgatccgcatggtgactaaagtcagcgcgtttgagggcgttaagtcgacgcagtaaattatttttgccctgaaaatgcgccagtgccagcgcgtcttctgcctccaggcgaggtgcgcgggccgccatccagtcggcgggatagaggaacaacggctgcgcttccacccatgcctgcgcgccgccgctatacagtaatcgttcgcgaacctgaaaacagcggcgcgtatgggcgtttattcgtagccagccgttaacgctgatcagcacagttaccgacgcgggataatccagcgccagctgcattcccaccagcgcaccgagcgcatggccgaccactgcgtaatgctcaatccctgcggctaccagcgcctgatgcagttccgctgccatctgggcgatactgtaatcttctgccagcgtgtcgggattattgccggtgccgcgctggtcgtaacagactacctgatactcctgctccagcaccgccagttgcggtaaccagtaactgccgctacccccaagacccgaaatcaacaccactacgggcgcatcagcataagggggaggtgagagtgaaagtttcatcgcggcctcacttggcgatatgcgcaattgtggcgatttccaccagcgcgtcaggttttaccagtccgcactgaatgcagaatcgcgccggtttatcacccggaaaaaactcggcgtagatttcgttaatcgcggcgtaatttttccagtcggtaataaagatgctgttgaaggtcacatccgccatcgtgccacccgccgtctcgatcaccttgcggatagtttccagaacgtggcgggtttgcgcctttgggtcatcggcaaacagcacgttattatgttgatcaaaagccagcgtaccggagacatacaccacgccatcagccagcgtgccgggaacgaagggggccagcggtgcgctgctgccagcgggaataattacggattttggcatcgttaaactccttaagcgatatgagcaaaggacgtgggagaaagcgcgtcgcagaatgtttcgacgtcgctgacccagccaaaaaaggtttcgatattgaacaacgcggctttctgcgcaaatttcggccccgcctggtgagttgcgtcttcaagcaccacgccgaaatactccagaaaaaagccgtcgcgtagcgtcgattcgacgcagacgttggtagcgatgccggtgaaaaccagatggcgtattccgcggctgcgcaaaatgctgtccagcggcgtattgaagaaaccgctgtagcgcggcttcggcagcacaatatcgccaggctgcggcaccagttcatccaccagttgataatcccaggagcctttcgccagcaatttcccctgcagctgcggctgcttacgcatggttttcagggcgttcgatttatgaaaattcggtgagccgggtccgccagcctcgacatactgttcatcccagccattttgaaaccagatgatcagcatccctgccgctcgcgctgcggtcacggcggtttgaatgttggcaatgaccgggcgagtggttgagacatcaaacccggcgagatctaagtagccgcctggcgtggcataagcgttttgcatatccaccacgatcagcgcactttgctgcggatcgaaggtaatggcttccggtcgagcggttaaggtcgtcatcatgccacctcctgagtcagcgcaggtagatgggcgcggcattgcatcagtggttgaatgcgctcgccgaaggtttcgattcccgacagaaaatcgtcgaaggttaacagcacgccttcggcaccaggcacgcttgcgacttcatctaacatgcgcgcgacactggcgtaagaaccgactaacgtccccatattgatgtttaccgccgaagtgggatcggccatctgacgaacgttggtgtcagtaccggagcgggtatctttctgactttgttcggttagccagcttaacgcctcttcatccgcgcccgctttgtagtgttcccatttggcgcgagcggcatcgtcggtttcatcggcaatcaccataaacaacacataagagccaacgtcgcgtccggtttgctctgcggcctgtttcatccgcgcagcggtcggggcgaaagccgtgggtgtatttacgcctttgccgaaacagaagttgaaatcggcataccgggcggagaacgccatgccagcgtcgctttgcccggcgcagatcactttcatggggacactcggttgcggactcacgcgacaatcattcatggtgaaaaaatcgcctttaaaatcgcttttccccgtgccccacaggtcgcgcagcacctgaacatattcggtgagatagtcgtaacgacgggagaaatagtcatcgccaggccagatacccatctgctcatactcgggcttttgccagccagtcacgaggttgacgccaaaacgcccgccagagatggagtcgatggttgcggccatacgggcgacgattgccggaggtaacgttaaggtggcagcagtggcgtaaatctgaatgcgcgaggtcacggccgccagccccgccatcaaggtgaacgactcaaggttgtgatcccagaactcagttttgccgccaaagccacgcagtttgatcatcgacagggcgaaatcgaaatggtagtgctccgctttttgcacaatggctttattcagttcaaaggtcggcatgtactgcggcgcgtgggtcgaaatgagccagccgttgttgccaataggtacgaatacgccaattttcatcatcaacctctcttcgtctcgtaaagtgaaagtcagacggggcgctgcatcctgcatatccttttcagccgcgtattggcttgtttgcaaagcggatgccagtttttaaaaagttaatgttattaatctgttaacattacgttatctaaaatatctggtaaaaagtggactaaacggtcaaaacagttgcacataaaacatgcatctgtgcgcgatgagagtgcagaaggtcgaggccgggcgggggttttgctatcctgttgccaatctacaagaggggagagcgcatgacgcaaggcgcagtgaaaacaacgggtaaacgttcgcgcgcagtaagcgcgaagaaaaaagcgattcttagcgcagcactggacactttttcacaattcggttttcacggcacaaggctggagcagatcgcagagttggcgggtgtttcaaaaaccaatctgctgtattactttccgtcaaaagaggcgctgtatattgccgtgctgcggcagattctcgatatctggctggcaccgttaaaagcgtttcgtgaagatttcgccccgctggcggcgatcaaagagtacatccgtctgaagctggaagtctcacgcgattatccgcaggcttcgcgcctgttctgtatggagatgctggcaggcgcgccgctgttaatggatgaactgacgggcgatttgaaggcattaattgatgagaaatcggcgctgattgccggttgggtcaaaagcggcaaactcgcgccgattgatccgcagcatttgatttttatgatttgggcttccactcaacattacgccgatttcgcccctcaggtggaggcggtgacaggcgcgacgttgcgcgatgaggtatttttcaatcaaacggttgaaaacgtgcagcggattattattgaggggattcgaccacgttaaagatgccggaggaggttgtaacatcctccggctacctgtttaacctatagtcattaagctggcgttaccgccagcggcagcggtattcacactcagcgaacgctcgatatacagccgttccagaaggatattgctttcgccacgggcaaaaccctgcaccgaaacaattgtgccatcccgcgcggcaactgcttcacacaatgcgcgaagctgatccgaatcaccgtggaagatcaccgcatcaaacggttgagcggttatattttccgctttcgccagttgaatacgttcgctgactgccgatggcaatgccttcactaactgacgatgcagcgcgtcatccggccacagtacctggctgcccaccgccagcacggcggcgagctgagtcagcgcatcctgctcatcatcggcaatacacaacacgcgctcacgcggcagcagcgtccaggtgttgcgttcacccgtcggccccggcagcaatcgttgtgttcctgcctgcgccagctcgccatattgcgtacataacgcctgcaattctggacgatttgctgcccattcccgcagtgcatttagcggctgagtcaatgcggctttcaactgcgcatcgaccggatactttgcatcctgacgcgcgagcgtcactgccagcgcactttccgggcgattcgccagcagacggtagagatagagcggaccgcctgctttcggcccggtaccggacaacccttcgccgccgaacggctgcacaccaaccactgcgcccaccatattacggttaacatacaggttaccaacatgggccgagccagtgacctgggcgatggtttcatcaatgcgcgtatggacgccaagcgtcagaccataaccggaagcgttaatctgctcgatcagctctggtagctggttacggttgtaacgcaccacatgcagcaccggaccaaagacctctttttgcaattcggcaaagtcatccagttcgatcagcgtcggggcgacaaaggtgccgctttgccattcacgggcatcttcgctgttttcccgcaccgcctggaacaccggacggcctttgctacgcatggtctgaatatggcgctcaatattggctttcgcttcgctatcaatcactggaccgatatcggtggtcaggcgacccggattacccatccggcattcggccattgcgccgcgcagcattttcaacgtgtggtcggcaatctcatcttgcaggcacagcacgcgcagcgccgaacaacgctgacccgcactgtcgaacgccgaggccagtacatccacgacgacctgttcggtcagtgctgaagaatcgacaatcatcgcgttcatgccgccggtttcagcgatgagcggaatagggcgaccctgagcgtccaggcggctggcgatattgcgctgcagtaacgtagcgacttcggttgaaccggtaaacatcaccccgcgcacgcgatcatcacccgtcagttgcgcgcccacggtttcaccccgacctggcagcaattgcaccacgcctggcggtacacccgcttccagcaaaatggcgatcccttgcgcggcaatcagcggcgtttgttctgccggttttgccagcacgctgttacctgccgccagtgcggcggcgatctgcccggtgaaaatagccagcgggaagttccacggactgatacacaccacaggccctaatggacggtgggtttcgttagcgaaatcatcccgcacctgtccggcgtagtagtggagaaaatcgaccgcttcgcgcacttcggcaatggcgttactgaaggtttttccggcctcacgcaccagaataccaatcagttgctgcatctggctttccatcagcacggcagcgcggtgcaaaatcgctgcgcgttcagccggaggcgtggcaaaccagattggcgcgttattaaccgcactttccagcgcctgttctacttcacgcggcgtggcttcacgcacatagcccacaatatctttcggttccgcagggttaataacgggcgacatctcacctgccgctaccggttgttccagcattggcaaggcctgccatttttgcagtgcactattgagcagggcagaggagagcgaggccaggcggtgttcgttagcgagatccagccctgccgagttgtcgcgcccgtgaccgtaaagatcgcgcggcaggggaattttcggatgcggtaatccagtttgcccttcctgttgcgccagtttttctacagcagtgaccggatcggcgaccagttcatccagtggcaaagaggtgtcggcaatacggttaacaaacgaggtgttagcaccgttttccagcaggcgacgcaccagatacgccaacagcgtttcatgtgtgccaaccggagcataaatacgacacggacggttaagtttgccgtcggcaactttcccggtgacctgctcatacagtggctcgcccataccatgcaggcactggaactcgtactgacccgggtagtagttctgccccgccagttgataaatcgccgccagcgtatgggcgttgtgcgtcgcgaactgcgggtagattagattcggcaccgccagcagctttttcgcacaggcgagataagaaacgtcggtatacaccttgcgggtataaaccggataaccttcaaggccgtccatctgcgcacgcttaatttcactatcccagtacgcgcctttcaccaggcgaatcatcagacggcgacggctgcgggtggcgagatcaatcaggtaatcgatcaccaacgggcagcgtttttgataagcctgaataacaaaaccgatgccgttccagcctgccagttccggctcgaaacagagtttttccagcagatcgagggagatctccaggcgatcggactcttcggcgtcaatgttgataccaatatcgtactgacgcgccagcagggtgagtgatttcagacgcgggtaaagctcttccattacccggtcatactgggcgcggctataacgcggatgcagcgccgacagtttgattgaaatgcccggcccttcatagatgccacgaccgttagacgctttaccgatggcgtgaatcgcctgctgataggaaaccatatacgcctgtgcatctgcggcggtcagcgcggcttcgcccagcatatcgtaagagtaacggaaacctttctcttccagcttgcgggcattggctaacgcttccgcgatggtttcgccagtgacgaactgctcacccatcaggcgcatcgccatatccacacctttgcggatcagcggttcaccgcttttaccgataatgcggttcagcgagcgggagaggctggcttcgttatgggtggaaaccagtttgccagtaaacagcagcccccaggtggcggcattaacaaacagtgacgggctacgaccaatgtgtgactgccagttaccgttgctgattttgtcgcgaattaacgcgtcgcgggtggctttgtcgggaatacgcaacaacgcttccgccagacacatcagcgccacgccttcctgcgatgacagcgaaaactcctgcaataacccctggaccatacctgcgcgaccactggcatttttttgattacgcagtttatcggccagctgatacgccagtttgtgcgcctgttcagcaactggctgcggcaggcgggcttgttccagcagcatagaaaccgcttcggtttccgggcggcgataggccgcggtgatcgcggcgcgggaaaccgactggggcaatatttgctcggcaaagtcgaggaatggctggtgtggttcctctgccggagtcggtgcttcatcgctctcattggccgcgccagaaagcagcgcaggtagctccggcagagtatcgctgttttccagttgttcgagataagaaaaaatcgcctgcttaattaaccagtgtggtgtgcgatcgatacgtgtcgcggcagacttaatacgctcacgcgtcgcgtcgtccagcttaacccccatggtggtggttcccatgccattactcctgttgttcagaaaggtgcaacttaacgttatcgtgaaatatccatgatgttgcaactttgtgcaaccatgttaaatgtgacatgcgtagcaagcttaaaaatgaatgaaatgttaataaaagaaatcgatatgacagggattaaaaaaataactcagactttttctctgcggcagttaacatttttgaaaggtgcaaccgcaaaaaatgtgagagagtgcaacctgatgaaaaatagtgtcgctgagcactaaaatttaatgtaaatggtgtgttaaatcgattgtgaataaccagcgcttccggcaggatacggtcgccctggtaaaacataaactctgttaccccgttccggtggcagatataacggcaagtttcgacattgccgataataattttttggagactttagatggctattagcacaccgatgttggtgacattttgtgtctatatctttggcatgatattgattgggtttatcgcctggcgatcaacgaaaaactttgacgactatattctgggcggtcgtagtcttgggccattcgtgacggcattatcggcgggtgcgtcggatatgagcggctggctgttaatggggttgccgggcgctgtttttctttccgggatttccgaaagctggatcgccattggcctgacattaggcgcgtggattaactggaagctggtggccgggcggttgcgtgtgcataccgaatacaacaataacgccttaacactgccggattatttcaccgggcgctttgaagataaaagccgcattttgcgcattatctctgcgctggttattttgctgttcttcaccatttattgcgcttcgggcattgtggcaggcgcgcgtctgtttgaaagtacctttggcatgagctacgaaacggctctgtgggcgggcgctgcggcgacgatcctttacacctttattggcggtttcctcgcggtgagctggactgacactgtacaggccagcctgatgatttttgccctgatcctgacgccggttatcgtcattatcagtgtcggtggctttggtgactcgctggaagtgatcaaacaaaagagcatcgaaaacgttgatatgctcaaaggtctgaactttgttgccattatctcactgatgggttgggggctgggttacttcgggcagccgcacattctggcgcgttttatggcggcggattctcaccacagcattgtccatgcgcgtcgtattagtatgacctggatgatcctctgcctggcaggggcggtggctgtcggcttctttgggattgcttactttaacgatcatccggcgttggctggtgcggtaaatcagaacgccgagcgtgtgtttatcgaactggcgcaaattctgtttaacccgtggattgccgggattctgctgtcggcaattctggcggcggtaatgtcaaccttaagttgccagctgctggtgtgctccagtgcgattaccgaagatttgtacaaagcgtttctgcgtaaacatgccagccagaaagagctggtgtgggtagggcgtgtgatggtgctggtggtggcgctggtggcgattgcgctggcggcaaacccggaaaaccgcgtgctgggcttagtgagctacgcgtgggcaggctttggcgcggcgtttggtccagtggtgctgttctcggtgatgtggtcacgcatgacgcgtaacggtgcgctggcggggatgatcatcggtgcgctgacggttatcgtctggaaacagttcggctggctgggactgtacgaaattattccgggctttatcttcggcagtattgggattgtagtgtttagtttgctgggtaaagcgccgtcagcggcgatgcaaaaacgctttgccgaggccgatgcgcactatcattcggctccgccgtcacggttgcaggaaagctaagggacttagcctgcggcggttttgtttggcttcagcagcgggttgcgctcccttaatgtgcctcgccatataaattgaatggtgcagggagcgcgcagggggcggccaatcgccgccgccccctgctgtcccggccttcggggaacgcttcagcgattttgacgccaccaacacccgagctgttattatgttccgggcaaaaagttagatttgataatcgcggatggacgaaattgcttgatacacccgcttatcagttttacatggaagctctgatgcattgagtctggacagttttgtcggctggatacggcgtttacgcggcatccggcaagaacacatggttctttgcaaacaatcccatctttctaccctggaataatcgtttatatcccttggcattacctctctttgtttacattccaacatcattttataaacattccgcttgtgtttttctttgccgtaatgataatcgctatcactgcgatttacttttctttgcatagattgactcagaaaaacgtttaagggtgggtggcatgtttgttccgtttctcattatgttgcgcgaaggacttgaagccgcgctgattgtcagtttgattgccagctatcttaagcgtacccagcgaggccgatggattgtgtgatgtggattggcgtgttgcttgccgctgcgttgtgcctgggcttgggtatcttcattaacgaaaccaccggcgaatttccgcaaaaagaacaggaactgtttgaaggtatcgtggcggtgatcgccgtggtgatccttacctggatggttttctggatgcgcaaagtgtcgcgcaacgtcaaagtgcaactggaacaggcagtcgatagcgcattgcagcgtggaaatcatcatggctgggcgctggtgatgatggtcttttttgccgttgcaagggaagggctggagtcggtctttttcctgctggcggcatttcaacaagatgtcgggatctggccgccgctgggtgcaatgctcggtcttgctactgccgtggtgctaggcttcctgctctactggggcggtattcgcctcaatcttggtgcattttttaaatggaccagcctgtttattctcttcgtcgccgcagggctggcagctggtgccattcgcgcatttcatgaagccggattgtggaaccactttcaggaaatcgccttcgatatgagtgcggtgctctcaactcactcgctgtttggcacgctgatggaagggatttttggctatcaggaagcgccgagcgtcagcgaagtcgccgtctggtttatttatctcatcccggcgctggtggcatttgctctgccaccacgcgcaggggcgacagcgtctcgctccgcgtaacaaatacgacgcaaactcttgcttagttacaacatactttaaagggatagtctcgtcatgaccattaacttccgccgtaacgcattgcagttgagcgtggctgcgctgttttcttctgcttttatggctaacgccgctgatgtgccgcaggtcaaagtgaccgtgacggataagcagtgcgaaccgatgaccattacggttaacgccgggaaaacacagttcattattcagaaccacagccagaaggcgctggagtgggagatcctcaaaggcgtgatggtggtggaagagcgggaaaatatcgcccctggctttagccagaaaatgacggcgaatttacagcctggcgaatacgatatgacctgcggtctgctgactaacccgaaagggaagttgatcgtcaaaggtgaggcaacggcggatgcggcgcaaagtgatgcgctgttaagtcttggtggtgcaattactgcatataaagcgtatgtcatggcggaaaccacgcagctggtgaccgacaccaaagcctttaccgacgcgattaaagcaggcgatatcgaaaaagcgaaagcactgtatgcaccgacgcgccagcactatgagcgtattgaaccgattgctgaactgttctccgatctggatggcagcattgacgcccgtgaagatgattacgagcaaaaagccgccgacccaaaattcactggtttccaccgtctggaaaaagcattgtttggcgacaacaccaccaaagggatggatcagtacgctgagcagctttataccgatgtggtcgatttgcaaaaacgcatcagtgaactggctttcccaccttcaaaagtggtcggcggcgcagccggactgattgaggaagtggcagccagcaaaattagcggtgaagaagatcgctacagccacaccgatctgtgggatttccaggctaacgttgaaggctcgcagaaaattgtcgatttgctgcgtccacaactgcaaaaagccaacccggaactgctggcaaaagtcgatgccaactttaaaaaggtcgataccattctggcgaaataccgtactaaagacggttttgaaacctacgacaaattgaccgatgccgaccggaatgcactgaaaggaccgattactgcgctggcggaagatctggcgcaacttcgcggtgtgctgggactggattaagcgttatgcagtataaagatgaaaacggcgtgaatgaaccgtcacgccgacgtttactgaaagtgataggtgcactggcgctggcgggaagttgtccggtcgctcatgcacaaaaaacgcaaagtgcgccgggtacgctttcaccggatgctcgcaatgagaaacagccgttttatggtgagcatcaggcagggatcctgacgccacaacaggccgcaatgatgctggtggcgtttgatgtgcttgccagcgataaagccgatcttgagcggttgtttcgcttgttgactcagcgttttgcttttctgactcagggcggagcagcaccagaaacgccaaatccgcgcctgccaccactcgattccggcattcttggcggctacattgcgcccgataatctcaccatcacgttatcggtgggtcactcattgtttgatgagcgctttggccttgcgccacagatgccaaaaaagctgcagaagatgacgcgtttccccaacgactcgctggatgcggcgttatgtcatggtgatgtgttgctacagatttgcgccaacacccaggacacggttatccatgcgctgcgcgatatcatcaaacacacgccggatttgctcagtgtgcgctggaagcgggaagggtttatttccgatcacgcggcgcgtagtaaaggcaaagagacgccgattaatttgctgggtttcaaagacggcactgccaatcccgatagccagaatgataagttgatgcaaaaagtggtgtgggtaacggcagatcagcaggagcctgcgtggacaatcggtggcagctatcaggcagtacgcttgattcagtttcgagtggaattttgggacagaacgccgctgaaagaacagcagacgatttttggccgtgataagcaaaccggtgcgccgctgggaatgcagcatgagcatgatgtgcctgattacgccagcgacccggaagggaaggtgatcgcgctggacagccatatccggctggcgaatccccgcacggcggagagtgagtccagcctgatgctgcgtcgtggctacagttattcactgggcgtcaccaactccgggcaactggatatggggttgctgtttgtctgctaccaacacgatctggaaaaaggcttcctgacagtacaaaaaaggctcaatggcgaagcgctggaggaatacgttaaacctatcggcggcggttatttttttgcgctgccgggggtgaaggacgcgaacgattatttcggaagcgcgttattgcgggtttaatgtttttaggcggataaggcatttgtgcgcagatgcctgatgcgacgcttgcgcgtcttatcatgcctacaatcagtgcgggtttggtaggctggataaggcgttcacgccgcatccggcgatcgtgcactgatgcctgatgcaaatcctgctgaaagcacacagcttttttcatcactgtcatcactctgtcatctttccagtagaaactaatgtcactgaaatggtgttttatagttaaatataagtaaatatattgttgcaataaatgcgagatctgttgtacttattaagtagcagcggaagttcccggcagtgatagtcagtcactatggagatcgcggatggtaacgtcctgtactggacatgttttagataatcaacgcgccaccactcgcggagttttctcctccggtagtcatctcgtcactttgcattttcaacctcatcctttcttttcatgtgttaccgacgccgtaaacggtgcgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgggcggcgtagaagccattggtatggcccgcgacagtcgcgatacttcgcccatcctcgcgcgaaatgaagcgcaattgcactatctgaaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggagatatcgcagaaaagtttgctccctattttcgcccggtctacgacgtgctggtccggcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgtgctccggattaagtgacgcgctggaacgtttcgaagaagatgaaatggttgggatcgtccggttcggtaaagaggactgcgtacgttcggcactttgccaacgtacgctgcatgcctacagttaagtgtgttatcggtgcagagcccgggcgaaccgggctttgttttgggtgtttatgcccggactagcgctttttctgaaacaaccatttttatttgcccctggctggtgaagtgtacgctcatcctgtggcttttttgtagttgctgatagagctcatcaggtattgctaagctctctgcatattcttgcggcgtatattggtaggctgcatgatgctgctgtttttgaaaacgcagcttattgtacagcgcccagacaattaacacgacggcattcgccactgccagcaaaaaatagaactgaagtcggcttctggcctcgctttgccagtaataacccgtcagcagatccatggcgaataagaatatgaacaacgcaaataatgtccacaagatggttgtggcaacataatcaaccagtaaacgtactggtgattgtcgggtcgtaataattaaattgttcatattaacctctcagaatcccgcgatcgggacttacccaacgggcgcgttgctttttaggcatcaacatgactcgtgtaaatgataccaatgtcgttgccaggctcagcatccagaaaataaccgggaaccaaataatccagaaaagcgatgaagtcagattatgctcatagcgattctcgatcatcaggctgacaataaattgcagtaaacataacgtacacaataatattccggcagtatgtgtcgcagcgatatgtgtcaattcaatatttaacggtacaccggcaagttggactgcgtaaataatgaaaccgaccaggcaggtgaaggcccatattgtcgtcaggcagtattcaaaaaacagcggccacattcgaaagttttctttgcgccacaaccttgtcatatttttgaggaatacttctgcaccgccctgagcccagcgcaggcgctgtttccacagcccttttaacgtttcaggcattaatatccagcacagtgcccgtggctcgtaaaaaatcgtccactgattcaactgcagcttccagctaatatcaatatcttcggtgatcatatcgtcactccagtaacccacttctgccagggcgctgcgacgaaatgcggcaataacaccggaaacggtaaatacgtttccatagatacgctgggttcgcttgatcaaaccaataattgaggaatactcgccaacctgaattttacccaccagggtagaacgtgttcgaatacgaggattaccggttacggcacccacacgcgggttgtacaacatcggttccacaatatatgccgccgcatcgcggtctaataacgcatcgccatcaatgcacaccagatattcacttttcgccgcggcagctccggttttaagcgcaatggctttcccctggttttgcgccagatgaatgacccgcaaatggggaatttgtgcagccatgcgatccaggatggcacgggttttatctgttgaaccgtcatttacggcaataacttcaatgttctcataacgctgtgctaaagcggcgtgtatggtttcctcaacgtttttctcctcattaaaacagggaatgataatggagatagacggattatctttcaactggggagctggtgcgttttctccccacggccagtggcgttcacgatagacccagaaatagacgccgccaacaatccacataatggacataaaaaacggccagaagaaaacgaacctcatcatcagttcaccagagtgaaagtacgctacgcataggggtatgcataacaccagacataatataaaaaacgatacgatgcgattaatcatttttcggataccaggctgttgaaaactcaggacgaataaggtctatttcaggttggttatgcagaaaattgtcgggataataaccatagtttttcactccattcagttgtaataggctcatccagtgagcgagttgttgcgaagaaatagcctgatgctgaccatttttctgccagttttgtgcctgtaattctaaaatagatttgtctttagcctgagggatgtttttaatttgattggtcaattgtattaaccattggtcagccgatttttctgcgacaccttccagataaggcatagccataatagcggtccagtcatagctttttaggaaatcagcataattctgtgcaaaccaggcttcactttcaggttgtattaccggaagtgcaaaaatatttcgtgcagttttaatatgtggaccgcgaatggcttttacgcgcgcactaagttctaaagtgaagtcagttaacgcacgacttttaaagcgggcccactgtttaaattgctccgggttttgtcgaatttcgctcagactcccgctaaagcctgcttgctgataagccgtgatagccggtgcactggcatcttcataatctgaaagcaaagcatcatcgtggaacaatatgccatcaaaagcagcatgtccggcaagatcttcatataacatgccaacttgtgctctgactctgtcatcgaaaggagagagacggtgatattgttcaggatgaatttgtgcttttttctcccctgttggtaagtattttactcgcgttaatgtgggatctaaatcccagcttaataccggcatccacgcatagatgtttacacctgagcgggtacgtaattgccaggcaacccgactaaaaatatctgctttcattggtagcaaacgatttggaaaccagacctctttgaccagcccatcaccatcgggatcagcaaatgcctgcaaatacacggttgatatttgcatatctttcacccgctgaattagcacatcaatattgcgatccatttgctggaggttttcgtcataaacgtaatcaagatcgatatgcattatccgttgtggtgatttttcctgtacggtaataatttgctgggcaaactcttttaatgagggattattggcgattaatacccgcggaatggaatccaattgcgacgcatttgccaaacctgattcaagggtgaagaacatgtcataaccgagtttttttaattcctctatcgctatgccattcgcttcgccataaggccaaacaaaaacgtgtggatttacctcaacctttgtacgcaggtattccgtcatttttacagcatccagacgaattctttcccggtattctgctgcggtttcataccgtgcgtggtcagtaaaatatgcacgatttacatatacaggcaataagctgccggtggcattagcctgaataccgtagtgagaattccatgtatgagaagcgagctcaacgagccgggaacgcgcaacttctcgcacttgttgccacgtggcaaaatattctcgatcgaccaactcatcgccaaattttacttgtttatccgctggcgtatcgacccaactgccgacgggggcccatacagcaggccactggaaggcctgaagaattgggaagacgcgggtataaaaactctggtagccgtcatcaaaagtcagcactacagctttttccggtagcggttttcctcctcgatgtgcttcacgaatttgagcaatactgaccggttgataaccgttctcgcgcagccaggcaaattgttcacgcagtgctgatgtccgcactgacataaaacgctggtcggcagcttcgtcttcaacgttatgccatgaaatcgctacaaaaccattatgcggccacggttgctcggcgagtaaagattcgcgatcctgtggcggtataaatgatgttcttgactggctaatgcacgcggtgagcataattatactcaccagcatcaggagatatttatttccattacgtaacatatttatccttaaaatctgaatgtcatatcgaattcaacgtataagttgtgttctctgtcaccgtcataaggtcgtttttcccagcgtagcgttgcgccagcatcaatcacgtcattccaactaatgcgttgcccgtagccgagttgggtgacgacatccgtgccataatgtttttgccaggaggcaccaacacctgcgctgaatatttgctcccagctattttcatagcttcgccataacaaatggcttgcctcaaatgccggaacaatatcgaacgtttttatagggttgtagtatggggtatcgtgttctgtattttgttcgtaatacagactgggtaggaaatcgacaatcaaatatggtgaagaccagatgcgttcctgaccctcaagtgagacttcatgacgctggttactgtcggaaaaatcagtgaaagcccaggagacaccgtacttacgccgctcattttgataccagcgaacataagcctgagcactgttgcctgtaacaccatttttcattgcccgtaatggaacgcggtgagagaggcgttccagttgcgaaccaatacgccagttatcattaaaatcataccagccagacaggcgcgcgccgggtttatgctcatgattgaaaacgcgttcagcgtactctgcctcgagccagatattacgtgaccgccactcaacacccgcaagccagtcgcgaacaatcccttttccttcgctaaattgtccatcggcataaccgaatccagcaaaaccgcgccagttatccttcagcggtggtgaataaacgatggtggttaagtcgacatcatgtttaccactatccgggccttcggcatcaattcctgttgagccagcgatacgaagctctgcaagattatgtacatcaaccgcacgttttaatcgtacaacgccgggatcttgcggttcacgttcgacaacatcgtgcgttaagacagctgcctgctgccattcttgtaacgttaatgctgtccaggcttgttcaacctccagattaatattacgtggctcgatcacttctgctttttttaattcattttctgctgcacgaggccaaccgcgggcttgtaacacactcgcgtaatcaatgcgcagtccctgatttcctggtgcgttataagcaagctctctggctgtcatttcagcctgaggaagatcattactatattttgctacggttgagagaaacgaatgcccctgtaaccaggtatcattcgggatgctcgtaggcgtgcccattaaccgaaggaaaggcggcgaagtattaatggtatgttgggtgacagttagcgcgcccggataattttcactctccaggtggctgtaaaagagatccgcaagttcttcatcggataaatccggggcaatggtctccttgtgataaaagagctcggtcattattgactgtgcttttttcggctgatgatctttgagataagccgatgcaacccaatattgcccccagggcggaataatttgccccgtcttttttaatcgctgatagtgagaaataacgtctttataacgatcgcgagttaataacgcgccaagatgatcaacctgaatacgctggtactgggcagtgcggtctgggttatcgtgccacagaatttctaatgcagcgtattgggcgagggcgcgatcggcaatggcataacgttcactttcactgcgcgtaggcataaacgacagtctgaccagttcggcatgaatatcagcgcgaatatctggcgttaaattggcatcgtcaatcgcggcagcaagttgattattacgtaatgcctgcacgtattctgtgggatattgttgcgtagatgcattttcaggtaatgactctgtcatcgcccgtaattcatcctgatgacgccccgccagtttatagatataggcttctgcgagtaaattggctttgtccggtgctccagagttaagctgcttaagtttaaccagcgcagtatcatagtgaccagcatctgccagggttaaaatttgtccccgttgataatccttattttgcggctccagagagagcgccttttgccacagtgtaagcgagttttgccattgttgcaggttacgataagcgacggcgacagctgcataaccacgcgctggtaattgctgatgacggtagcggttgtaaacggtaataacctgtttatcttgcccggcccataaggcaatctgtaaccagtcagcaatttggttattgctgagtgctgattttagtgcaaaccatgacaaagctggctgagtattacccttgcgagcttcaataatcaatgcatcataggcgttattaacagcactcttcgccgcgggactcgctgctaaaaatgcggcagtaagaagtttcaaagcccatttggttttcgggcacctttttctgctacttgaatacatcctgtattactccatgtattgccaaaatctctctctgtatctaattacaggtaactgaaaagaaagatatttttgcacctcataatccgttattaaacgcggaagagagacgtgaattgttgatgatgagaagaagaaatgatgagcagagtgtccatataaaatccttttctcgcccgaaaatccattccaatgatgaggatcttcaggaatacggcataaatcccaatgcctttttcaaaataaattaggattaaaataattaaatcagtaaattccgatgcatgatttcggatttttcgaaagtcctgatgaaaggctgcgctacggcactcacggatttaattgttattcctaatgtatctatgaattaatgttttataaggattttctataaccatttataagtattttcaagcctggcttgttgcaaacaatgtataaagcacttaggcaataataattacattcagcaactatcatcatcggtattgtttgtgggcggaatttcatattgacaacagtacagttcttatatctattaataatagaaagggatctacaacctacagattggtgtagctttatggaaaaagactatttgagaattagtagtactgtattagtgagcttattgtttgggcttgctttggttttggtgaatagttggtttaatcagccaggcgttgaggaagttgttccacgatcaacctatctgatggtaatgattgctttattttttatcgatactgttgcatttatttttatgcagttgtatttcatttatgaccgtaggcaattttcaaactgtgtacttagtttggcttttctgagttgtttgatttactttgttataaccgtcattatcattcagcaaattattgaggagcgtttgacaagcagtgttgtccaaaatgacattgcaatctattatttgtttcgtcagatgagtttgtgcatattaatatttctggcattggtgaataaagttagtgaaaacacaaaacagcgcaatttattttccaaaaaaatgactttgtgcataagtttgttttttgtttttggggggccgatagttgctcacatactttctagtcattatgagagctacaatttacacattgccgagttaaccaatgaaaatggtcaggtggtttggaaagcctcatatgttaccataatgattttcatgtggttaaccttgctttcggttaatctatactttaatggtttacgctatgatatctggaatggagtgacggtgattgctttttgtgccgtactgtacaatatctctctgttatttatgagcaggtatagcgtgtccacttggtatattagtcgcactattgaagtagtcagtaagttaaccgttatggtaatatttatgtgccatatattcagtgcgctacgagtaacaaagaacattgcacatcgcgatcccttaaccaatatatttaacagaaattatttttttaatgaactgacagttcaatcagcatcagcccaaaaaacgccttattgcgtcatgattatggatatcgaccacttcaaaaaagtcaacgacacctgggggcatccggttggcgatcaggtgataaaaacagtggtgaatatcattgggaaaagcatacgaccagatgaccttttagcgcgcgtcggcggcgaagagtttggcgtcttgctgacggacatcgatactgaacgtgcgaaagctttagcggaaaggattcgggaaaatgttgagcgtttaactggcgataatcctgaatacgctataccacaaaaagtgacgattagtattggcgctgttgtgactcaggaaaatgcgttaaacccaaatgagatctatcgactggctgataacgcactttacgaggcgaaagagaccgggcgtaataaggtggttgtgagggatgtggtgaatttttgtgagtcaccataaagcggcattttgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgaccacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagtgcctggcacacgcgtttgatggaagacggcgttcaggcaatgcgcgattatcttgccggactggatatcgcttcgccagagcatcaggttctgatgaacgtaacagcaaaaagcgaggtcgctccgtcaattatcaaagaaaatctctcattacacttaactcatacggtgaaatggactgaatctctcgatacatttctgaatatgccaaccccggtagctttccttgaaataagtaataagccctatttggggaatatgttaaatgattttgctggcgtggatcagcaacgagttatgcattgtcgtaaagcatttagtgatgcaaaggtattcaaatgattcctgattatttaacttttattcgctttcaggataaacgaaatctgatatacatttatgctattggacttattctgataggcttttattggaagaatgcagggtttacttttccatcagaggatattggtgtagttagtgggattctggctctggtgctgtataattttatttttgatctcaaggcgtactgggcttataaatgcgtcacgaagaatatcgatttttcgtggtttaagaaaaagcagaaccacaaaatagaattatttcttacacaacctctggtggcaggatttctgtcgttaatcatgttgagtgcaatgagttgggggctataccagcttctaccctcgttatatgcgctgttcctgatttcgttacttgggccgttggtcatctttctgctgtttcggatgatccgcaccagttatgtcaagcaggtcgctatttcagtagcgaaaaaagtaaaatataaaagtctgactcgctatgtgctgctttcggtgtgcatctcaacggttgttaacctgcttactatcagcccgttgcgtaacagtgattcttttgtgacagaggggcagtggttaacgtttaaatcgataattgcattgctcattctttgtggcgtagtgttggcgattaatctgttttttctgcgcttctccaagcggtacgcttttctgggcaggctttttttgcaggaaatcgatctgtttttctccagtgaaaatgcgttgtcgaccttttttgccaagccgctttggcttcggttattcatattgctggttattgaagtgatgtggattacgctggtgtcggtattggcaacgcttgtagaatggcggatttggtttgaagcctattttttactctgctatgtaccgtgcttaatttactattttttctattgtcgattcctctggcataacgattttatgatggcatgtgacatgtatttccgttgggggcattttaataagtgaggaagtgataggaagtgaccagataatacatatatgttctgtactctcttgcgcattttgattgttgactgagtaaccagacagttgatgtgcacgatttcccctcgccctaacagacgtgggcgggggcacccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgacccccggtcggggcttctcatccccccggtgtgtgcaatacacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgaaccccggtcggggcttctcatccccccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgaaccccggtcggggcttctcatccccccggtgtgtgcaatatacgaaaaaaaagcccgtactttcgtacgagctcttctttaaatatggcggtgagggggggattcgaacccccgatacgttgccgtatacacactttccaggcgtgctccttcagccactcggacacctcaccaaattgtcgttcctgtcttgctggaacgggcgctaatttagggaaatcatgacctgaggtcaacaaactttttgaaaaaatcgcgcgtttattcaaacttcaatcaatgtgtggttttaataagcgaaatctgctttttttgccaccgaccacggatttgttatgctggtggcctttgtagatcataacgataagtgcgaataaatttcgcacaacgcttttcgggagtcagtatggatatcatcttttatcacccaacgttcgatacccaatggtggattgaggcactgcgcaaagctattcctcaggcaagagtcagagcatggaaaagcggagataatgactctgctgattatgctttagtctggcatcctcctgttgaaatgctggcagggcgcgatcttaaagcggtgttcgcactcggggccggtgttgattctattttgagcaagctacaggcacaccctgaaatgctgaacccttctgttccactttttcgcctggaagataccggtatgggcgagcaaatgcaggaatatgctgtcagtcaggtgctgcattggtttcgacgttttgacgattatcgcatccagcaaaatagttcgcattggcaaccgctgcctgaatatcatcgggaagattttaccatcggcattttgggcgcaggcgtactgggcagtaaagttgctcagagtctgcaaacctggcgctttccgctgcgttgctggagtcgaacccgtaaatcgtggcctggcgtgcaaagctttgccggacgggaagaactgtctgcatttctgagccaatgtcgggtattgattaatttgttaccgaatacccctgaaaccgtcggcattattaatcaacaattactcgaaaaattaccggatggcgcgtatctcctcaacctggcgcgtggtgttcatgttgtggaagatgacctgctcgcggcgctggatagcggcaaagttaaaggcgcaatgttggatgtttttaatcgtgaacccttaccgcctgaaagtccgctctggcaacatccacgcgtgacgataacaccacatgtcgccgcgattacccgtcccgctgaagctgtggagtacatttctcgcaccattgcccagctcgaaaaaggggagagggtctgcgggcaagtcgaccgcgcacgcggctactaataaagcatcaggattcctgctatccttggcgggaattgaatacaggagagagttatgtatcccgtcgaccttcatatgcataccgttgccagcacacatgcatatagcacattaagtgattacattgcccaggccaaacaaaagggcattaaactttttgcgatcaccgatcatggcccggatatggaagatgcgccgcatcactggcacttcattaacatgcgtatctggccgcgagtggttgatggggtagggatcctgcgcggcatcgaagctaacattaaaaatgttgatggtgaaattgactgcagcggtaaaatgtttgactcgctggatctaattattgccggttttcatgagccggtttttgcgccacatgacaaagcgaccaatacacaagcgatgatcgccactatcgccagcggcaatgtgcatataataagccatcccggaaatcccaaatatgaaatagatgtgaaagccgttgctgaagcagccgcgaaacatcaggtggcgctggaaatcaataattcctcatttttacactcacgtaagggcagtgaagacaactgtcgtgaggtagccgcagcggtacgtgatgctggaggttgggtggcattaggctcggattctcacaccgcgtttaccatgggggaatttgaagagtgtcttaaaatcctcgacgcggtagattttccgccagagcgcattttgaatgtttctccgcgccgcttactgaacttccttgaatctcgcggtatggcaccgattgcggaatttgcagacctttaattactagtaatggaaatatattaatgaacgagttttctatcctctgtcgtgtgctgggttcgctctattaccgccaaccacaagatcctttactggtgccgctgtttaccctgattcgtgaggggaaactggctgcgaactggccactggagcaggatgagttgctgacacgtttgcagaaaagctgtgatatgacgcaagtctctgccgattacaatgcgttgtttatcggcgatgaatgtgctgtgccgccatatcgtagcgcatgggttgagggcgcgacggaagcggaagtgcgcgcttttctttctgagcgagggatgccattagcggatacgccagccgatcacatcggcacattgctgctcgcagcttcctggctggaagatcagtcaacggaagatgagagcgaagcactggaaacactgttcagtgagtatctgttaccctggtgtggtgcgttccttggcaaagtggaggcccatgcaaccacgcctttctggcgcaccatggcaccgctaacccgcgatgccattagtgcaatgtgggacgagctggaagaagattctgaagaataagtgtgatctacgtcactcataactgcaacggataatttgttgttgcataaaatgtgtgctcgatctcattcatggccgcgttttctgctatcatgcgcggcatgaacatacttctctctattgcaatcacaacaggcattctctccggtatctggggatgggtggctgtttccctgggcttactaagctgggcgggcttcctgggctgtacggcctactttgcctgcccgcaaggtgggctgaaagggctggcgatctccgctgcaaccctgcttagtggcgtggtgtgggcgatggtcattatttacggtagtgcactggcaccacatctggaaattctcggttatgtcataaccggtattgtcgcgtttctgatgtgtattcaggccaaacagctgctgctttcatttgttccggggacgtttataggcgcatgcgcgacgtttgccgggcagggtgactggaaactggtgttaccttcgctggcgcttgggctgatatttggttacgcaatgaaaaacagtggcctgtggctggcggcgcgtagtgcaaagacggcgcaccgtgagcaggaaatcaaaaataaagcgtgaggggcactcacgctttcgcttaaacagtaaaatgccggatgataattccggcttttttatctgtcaggattccggtggaaccgacatatggcggtatttcaccagaatgtcattctgccgttctgctttattttgcaaatcccacagaccacggtcgataccatcattaatcaggaaaatgacccctgtttcgatagccgacatcaggcacagcataacaggttcgttcgaggtgtaacccacttccccttcaagcaagcgctggtagtcaataaagcggaaaaccccggcctgaacttcataggaaagtatcgtcttactggtgttcaccgaagaaaggatctcgccggtactcacattgacgacgcgcaggttcacggcaatctgatcgagctggtattgcgtgtcggcaccgatgccaaaatatcttgccccaaccccgccagatttgacgttgctttcataaccgataatcgaaccttcaaccatgatatttgccgccgttaaagattgcagcgggattcggttattaatggcaaccgtgccgttttcttgtgccgcacgaataatcttgcgctcgttaagcaggttttgtaagccctggcgctccagcggtataaaccagcgagaatctttcagtgccgtgaccagcattgccgtggcgctttgcggaacagcagtggagaagttacttgccgggtagggtttaaattgcccggtttcgtcctgaatgttgtataccgaaacaaagattttacccgtcggcgctggcagatgggtcaaatctttgtagctctgagcacgaggcattaatgtcggtctggcggcttctttaggcggggcggttaagcatccgctcagtaacatgacggcaaccaaaagaaataagcgctgcatgattattttccttatgaagctggggcttaaaaatcggttgagttattttgtaaacccgaaacctggatggtcgaggtttgtccggttttacgatctgtcacgttcaactgcaattgaccatcgcggttggcaatatcgacaatataatcgttggtcaccatgcggcccggtttaccggtattaatattcgacagtagcccacctaaaatttgtgactggatggcctgagtaaagttatctaacgctgagggtgtttcaataccaaagtcatcgttatagctcggatctttataagagttttgggcctgagcgctatttaataaaaaagcgccattatttgggttaccaccaaagtttggattacggaactggaaagtcatggttccagcccaacttaatggcgaaataagcatgagtagaactactgcatgtttgacacgcattgcagcctccgaacaattttttatttagaattcatcatgcgccaaatcgcccgtacttaataacgcctgatttatctggcgacgatttagtgcttcttcagtttgaatcagtgcaaagacgacagttttctcgaagtctcttttcaacggaaataaaaaagtctggaaaataacgtcctgattgaccgttatagtgatccagcttccccatcgtgcactgggcctttcattaatcgttaagttacccgtatagtcactttcccatttatcactaaaggctcggtaaaaatcatggccaatagatgaaacagtatggtcagttagcaatcccgggacttctacctcaacggcgtgaagattccctgcggcgaacagaaattctgccgccacaatccagcgtaaataacgtttcatggctttatcgcctgaggttatcgtttgcccaggaaaccgcttgtgtccggttttttacggctatcttcttgaaaagattataaagatgcgttttaaccgtattttcgctgatgaacaacgaacgagcgatctcgttattagacgcgccgatacgcagcttattcaggatctctttttcccgatgagtaaggagggctgattccgtgctgttataacgatagttacctgaatgcgtaatcaggtagctggcaagcttttgcgtaaagtagcattcgccgcgcaggacgccttgcaacccattgacaacacgttcttgatcctccatggaataaaaaacgccgttgatatgaggccagttttcaatgtcgcggtacgggtaatcttcaggcgtatttagcaacaatattttgatattgttgtttttcctgctcaaagtatcctgccaataatggataagctttttatccgcttccatcatatccagaagaataatagagcctgaagagatatcgtccagagaacgttgaatattatgtaattttcctgtaattgccagcgattgtttaaggtgctgcaagagagctgtcgcctgcaaagaagatttagtgatcaacaataatgtatgaccatgaatactatggacttcattaaacatgatgaaaccccgctttttttattgatcgcacacctgacagctgcctctaaaatagaagcaccagaagtactgacagatgttgcactgctgtgtgtagtaataaatcagccctaaatgggtaaaatataaaactaatggattacatctgatttcaatctagccattacaaatcttaaatcaagtgttaaacatgtaactaaatgtaactcgttatattaaaatgttaaccttaaggttttattaagtttagaaatgatagaaaagttgtacatttggtttttattgcacaattttaaaaaatcatacaaatggtgataacttactaataatgcatataaaaaatatttcggtgtagtcctttcgtcatgtaaaacgttcttgttttttctccacacctccgtggacaattttttactgcaaaaagacgaggtttgtcacggcttgtgcgcaagacatatcgcagcaatcagcgacgggcaagaagaatgactgtctggtgctttttgatagcggaaaacggagatttaaaagaaaacaaaatatttttttgcgtagataacagcgtatttacgtgggttttaatactttggtatgaactaaaaaagaaaaatacaacgcgcgggtgagttattaaaaatatttccgcagacatactttccatcgtaacgcagcgttaacaaaatacaggttgcgttaacaaccaagttgaaatgatttaatttcttaaatgtacgaccaggtccagggtgacaacatgaaaaacaaattgttatttatgatgttaacaatactgggtgcgcctgggattgcagccgcagcaggttatgatttagctaattcagaatataacttcgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgaccagacaggagattataaccttgcatatattgatcaggcgggcagtgccaacgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaatttccattcgacttttaaatcaatccgatgggggttttacatgaaacttttaaaagtagcagcaattgcagcaatcgtattctccggtagcgctctggcaggtgttgttcctcagtacggcggcggcggtaaccacggtggtggcggtaataatagcggcccaaattctgagctgaacatttaccagtacggtggcggtaactctgcacttgctctgcaaactgatgcccgtaactctgacttgactattacccagcatggcggcggtaatggtgcagatgttggtcagggctcagatgacagctcaatcgatctgacccaacgtggcttcggtaacagcgctactcttgatcagtggaacggcaaaaattctgaaatgacggttaaacagttcggtggtggcaacggtgctgcagttgaccagactgcatctaactcctccgtcaacgtgactcaggttggctttggtaacaacgcgaccgctcatcagtactaatacatcatttgtattacagaaacagggcgcaagccctgttttttttcgggagaagaatatgaatacgttattactccttgcggcactttccagtcagataacctttaatacgacccagcaaggggatgtgtataccattattcctgaagtcactcttactcaatcttgtctgtgcagagtacaaatattgtccctgcgcgaaggcagttcagggcaaagtcagacgaagcaagaaaagaccctttcattgcctgctaatcaacccattgctttgacgaagttgagtttaaatatttccccggacgatcgggtgaaaatagttgttactgtttctgatggacagtcacttcatttatcacaacaatggccgccctcttcagaaaagtcttaatttgttgaaatatcgagcataagatgaatctggagagaatggtctgctgcgaatcagccaacctgaaagtatggataacacaaccctcaaggatgactaatcattgaggaaatagaataaatgttcagaccttttttaaactctcttatgctcggcagtttgttttttccttttattgccattgctggaagcaccgtgcaagggggcgtgatccatttttatggccaaattgtggaaccggcatgtgacgtcagcacccagtcatcacccgtagaaatgaactgcccacagaatggttctattccgggcaaaacctactccagcaaagcgttaatgagcggcaatgtcaaaaacgcgcaaatagcctcagtaaaagtgcagtatcttgataaacagaaaaagctggctgtaatgaacatcgaatataactaagtttctgaacaactcacgttgctgagcagaaaaatgcgatttaaccaaaaagcctgctgtacacttaagaaacaagaaggtgtaaggaggcgttatgaaaacgcgtattcatgttgtgcagggtgatattaccaaactggccgttgatgtgattgtgaatgcggctaatccgtcattaatgggaggcggcggcgtcgatggggccattcatcgcgcagcgggtccggccctgctggatgcttgtttaaaagtcaggcaacagcagggcgattgccctacggggcatgccgttattacgcttgcaggcgatcttcccgctaaagccgtagtgcacaccgtcgggccagtctggcgtggtggtgaacaaaacgaagaccagcttttgcaggatgcctatctcaatagcctacgactggtggcggcaaacagctatacgtcagtggcttttcctgcaatcagtactggggtttatggttaccctcgtgcggcagcggctgaaatcgcagtaaaaaccgtttcagaatttattacccgtcacgctttacccgaacaggtatactttgtctgttatgatgaagaaaacgcccacctctacgaaagactccttacccaacaaggagatgaatgatttgccccggctggcgagcgcggtgctgccactgtgttcgcaacatcccggtcagtgtggcctttttcctctggagaaaagtctggatgcgtttgccgcccggtatcgtctggccgaaatggcagagcatacgctcgatgttcagtattacatctggcaggacgatatgtcgggtcggttactgttttccgccctgttagccgcagcaaagcgtggcgttcgcgtccgtttgttgctggacgacaacaatacgcccggacttgacgacattttacgcttgcttgacagtcatccacgcattgaagtccggctttttaatcctttctcgtttcgcttgctgcgtccgcttggttatatcaccgacttttcccgtcttaatcgccgtatgcacaataaaagtttcactgtcgatggcgtggtgaccctggtgggaggacgaaatattggtgatgcctattttggagcaggggaggagccacttttttcggatttagatgtcatggcaataggacccgtggtagaggacgttgccgatgatttcgcccgctactggtattgcaaatcggtttcacccttacagcaggtgctggatgtcccggagggtgaaatggcggatcgcatcgagttacccgcctcctggcataacgatgccatgacgcatcgttatttacgcaaaatggaatccagtccatttataaatcatctggttgatggaacattgccgcttatctgggcgaagacacgtttattaagtgatgatccggcgaaaggggagggcaaggcaaaacggcattcactgttaccgcagcgcctgttcgatatcatgggctcacccagtgaacgcatcgatattatctcttcctattttgtaccgacacgcgcaggtgtggcgcaactcttacggatggtgagaaaaggggtaaagattgcgatcctaaccaattctcttgccgctaacgatgttgctgtcgtccatgccggatacgcgcgctggcgcaaaaaattgctccgctatggcgtggaattatatgaactcaagccgacgcgtgaacaaagtagtacgttacacgatcgcggcataaccggtaattccggagccagcctgcatgctaaaacctttagcatcgatggtaaaacggtgtttatcggctctttcaatttcgatccgcgttcaacattgctcaatactgaaatgggcttcgtgatagagagcgaaacgctggcacagttaattgataaacgctttattcagagccagtatgatgcggcctggcagctccgtctggacaggtggggacggatcaactgggttgatcgtcatgcaaagaaagagattattctcaaaaaagaacccgccaccagtttctggaagcgggttatggtcagactggcgtcgatattgcccgtggaatggttattgtaaatgtggcttaacgggctggtgctttatcgttctcacgcttaacaaccggtttaccagagaacaaaaacttcagtaacgggatgcgcaaatgaatttcatacagaattatcgcaatccctactacaaatatcaggccacagagaaaaccaagccagttggaggtgatgtgcggtgtaatgtatgcgccgaaaaacagcgttaacgggtggtgaaccagatagataaacagcgatgcgttaacaaaataagtcacccgcgctgactggaagttaagcaaacggtggccaaaggagaagaccacattcaccatccacagaccgaggaccatggtgatcaccgactcggtttcgtacatccaggcatcgccactgccatagcgctggttgagtaaataagcgacaaacgccaatgctgctgcaagggtacagccacgagacggcgtggtaaacaaggctttaagatgagggaaaatgaaagccagtgcgccgaggataaagaacggcaaataaaacagcgtttgcatgacaataaaattgaacatgccattactcagaatgggcggatacacaataaaaatcgttcttcttattaccgcataaccgatgccgaggcataaaaaaatcaccgatagttttaccatcgagaattttttattcgttttatcagaattttctaaattatttctgatgcgcttaaatatccatacgcacagcgtcgtcatgaccactaacaccagtaaaaaccacaggtgtgatattaattcccaggccaacgtattatatttgtcatacaatgacagcccaggccaactttccgcttttcctttgacatattgcagcataataaattgcggtaatgtcagtagggggatggctgttaacatcgggatacctacacgttcgacacgtactttccaccattttttcaagggatagcgtaaaaaaagcatgtaggaaaagtagccggatataacgaaaaatacctgcatgcggaacgagtggatgaagtcattaaaaagggtcagccacaatgatgattcggcgctattcacatgccatgtatggctcgaatagattaaagaaatatgaaaaggtatccctaacaacatcagccaggcgcggatggagtcgaggaaatattcacgttgcgcgggtactgggttcatatatggttaactaatctcggatttttcgtcttatccctgtcgggttatgcctttaggcttgttgccatagtgacaccgacctgaccgcgccaggcgcaggcttcaaggtttttatgcatagcatcatcgctaccactaaccagaatggaagcgtctgtaagacggttgataaataaatttgctggcaaaccctacacgaagtcgatgcttctgtctttaggagaagcacggaaagtgaaaacggttgcaatcaggtgcttaatccatgagccagcgtgctgaacgataccgggattctgttgtcggaatggctggttatccattaaaatagatcggatcgatataagcacacaaagggggaagtgcttactaattatgaaacataaactacaaatgatgaaaatgcgttggttgagtgctgcagtaatgttaaccctgtatacatcttcaagctgggctttcagtattgatgatgtcgcaaagcaagctcaatctttagccgggaaaggctacgagacgcccaaaagcaacttgccctccgttttccgcgatatgaaatacgcggactatcagcagatccagtttaatcatgacaaagcgtactggaacaatctgaagaccccattcaaactcgagttctaccatcagggtatgtacttcgataccccggtcaaaataaatgaagtgactgccaccgcagtcaaacgaatcaaatacagcccggattatttcactttcggcgatgttcagcatgacaaagatacggtaaaagaccttggctttgccggttttaaagtgctttacccgatcaacagcaaagataaaaacgatgaaatcgtcagcatgctcggggccagctatttccgcgtgattggtgcaggtcaggtttatggcctttctgcccgcggcctggcaattgataccgccttgccatcgggtgaagaatttccgcgcttcaaagagttctggatcgagcgtccaaaaccgactgataaacgtttaaccatctatgcattgcttgactcgccgcgtgcgacaggtgcttacaaattcgtggttatgccagggcgtgacacggttgtggatgtgcagtcgaaaatctatctgcgcgataaagtcggcaaactgggggttgcaccgttaaccagtatgttcctgtttgggccgaaccaaccgtcgcctgcaaataactatcgtccggagttgcacgactctaacggtctctctatccatgccggtaatggcgaatggatctggcgtccgttgaataacccgaaacatttagcggtcagcagcttctccatggaaaacccgcaaggctttggtctgttgcagcgcggtcgtgatttctcccgctttgaagatctcgatgatcgttacgatctccgtccaagcgcatgggtgactccgaaaggggagtggggtaaaggcagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgcagagatgaaaaaactgccagaggataccccggtcacagcgcaaaccagcattggtgataatggtgagatagttgaaagcacggtgcgctataacccggttaccaaaggctggcgtctggtgatgcgtgtgaaagtgaaagatgccaagaaaaccactgaaatgcgtgctgcgctggtgaatgccgatcagacgttgagtgaaacctggagctaccagttacctgccaatgaataagacaactgagtacattgacgcaatgcccatcgccgcaagcgagaaagcggcattgccgaagactgatatccgcgccgttcatcaggcgctggatgccgaacaccgcacctgggcgcgggaggatgattccccgcaaggctcggtaaaggcgcgtctggaacaagcctggccagattcacttgctgatggacagttaattaaagacgacgaagggcgcgatcagctgaaggcgatgccagaagcaaaacgctcctcgatgtttcccgacccgtggcgtaccaacccggtaggccgtttctgggatcgcctgcgtggacgcgatgtcacgccgcgctatctggctcgtttgaccaaagaagagcaggagagcgagcaaaagtggcgtaccgtcggtaccatccgccgttacattctgttgatcctgacgctcgcgcaaactgtcgtcgcgacctggtatatgaagaccattcttccttatcagggttgggcgctgattaatcctatggatatggttggtcaggatttgtgggtttcctttatgcagcttctgccttatatgctgcaaaccggtatcctgatcctctttgcggtactgttctgttgggtgtccgccggattctggacggcgttaatgggcttcctgcaactgcttattggtcgcgataaatacagtatatctgcgtcaacagttggcgatgaaccattaaacccggagcatcgcacggcgttgatcatgcctatctgtaacgaagacgtgaaccgtgtttttgctggcctgcgtgcaacgtgggaatcagtaaaagccaccgggaatgccaaacactttgatgtctacattcttagtgacagttataacccggatatctgcgtcgcagagcaaaaagcctggatggagcttatcgctgaagtcggtggcgaaggtcagattttctatcgccgccgccgtcgccgcgtgaagcgtaaaagcggtaatatcgatgacttctgccgtcgctggggcagccagtacagctacatggtggtgctggatgctgactcggtaatgaccggtgattgtttgtgcgggctggtgcgcctgatggaagccaacccgaacgccgggatcattcagtcgtcgccgaaagcgtccggtatggatacgctgtatgcgcgctgtcagcagttcgcgacccgcgtgtatgggccactgtttacagccggtttgcacttctggcaacttggcgagtcgcactactggggacataacgcgattatccgcgtgaaaccgtttatcgagcactgcgcactggctccgctgccgggcgaaggttcctttgccggttcaatcctgtcacatgacttcgtggaagcggcgttgatgcgccgtgcaggttggggggtctggattgcttacgatctcccgggttcttatgaagaattgccgcctaacttgcttgatgagctaaaacgtgaccgccgatggtgccacggtaacctgatgaacttccgtctgttcctggtgaagggtatgcacccggttcaccgtgcggtgttcctgacgggcgtgatgtcttatctctccgctccgctgtggtttatgttcctcgcgctctctactgcattgcaggtagtgcatgcgttgaccgaaccgcaatacttcctgcaaccacggcagttgttcccagtgtggccgcagtggcgtcctgagctggcgattgcactttttgcttcgaccatggtgctgttgttcctgccgaagttattgagcattttgcttatctggtgcaaaggaacgaaagaatacggcggcttctggcgcgttacattatcgttgctgctggaagtgcttttttccgtgctgctggctccggtacgcatgctgttccatacggtcttcgttgtcagcgcgttccttggctgggaagtggtgtggaattcaccgcagcgtgatgatgactccacttcctggggtgaagcgttcaaacgccacggctcacagctgctgttagggttagtgtgggctgttgggatggcgtggctggatctgcgtttcctgttctggctggcaccgattgtcttctcgttgatcctgtcaccgtttgtttcggtgatttccagccgtgccaccgttggtctgcgcaccaaacgctggaaactgttcctgatcccggaagagtattcgccgccgcaggtgctggttgataccgatcggttccttgagatgaatcgtcaacgctcccttgatgatggctttatgcacgcagtgtttaacccgtcatttaacgctctggcaaccgcaatggcgaccgcgcgtcaccgcgccagtaaggtgctggaaatcgcccgtgaccgccacgttgaacaggcgctgaacgagacgccagagaagctgaatcgcgatcgtcgcctggtgctgctaagcgatccggtgacgatggcccgtctgcatttccgtgtctggaattccccggagagatattcttcatgggtgagttattacgaagggataaagctcaatccactggcattgcgtaaaccggatgcggcttcgcaataaaaacgtagttgcctgatgcgctacgcttatcaggcctacatcgttcctgcaatttattgattttgcaagactttgtgggtcggataaggcgttcacgccgcatccggcaaaaacaacgagccaataaaaataccggcgttatgccggtatttttttacgaaagaggtatcaaatgcgtttaattgtggtgagcatcatggtgaccttgctgagtggctgtggcagcattattagtcgcactataccggggcaggggcatggcaaccaatattatcccggtgtgcaatgggatgtgcgtgactccgcctggcgttatgtcacgatccttgatctgccattctctctggtttttgatactttactgctgccgatcgacattcatcatggcccgtatgagtgattaacgttcatcccactcatcagctgctgcgcgtccttcctcggtatccagcggtggctcaagctgaaattccccctcgtcccattcatgtaatgtattctcttcctgccactcctggcgtatctctatctcatcatagtcgccatcaaaaacactttgcgcggcttcaccgctaagcataggtaaacattcaccttcttccccttcgtcggcaaaaaactcaacttgccacatgatgtcgccgtcctgcaaaacgtatttttgggcattgaactgttgcacattcgcatcttcggcgtcgatgccggggttgtctgcaagaaattcttcgcgtgcagcgtcaatggcttcttcaagcgttgcgtacatggtcatcacgattctccctttgagttgatgaggtttcagggaaaaggatagctgattctccgcttttgcaagtatgaaaggcgaaaaatcagttcgatacctggggtattcgacgacgacgtagactgttccatgaatagactgcgttgaataacactacgccagcggtgacgagaaataccgctctgaaaccgtagttcgctgaaatcgctgctcccatcaatggtccggtaacgttgccaatatcacgaaacgattggttatagctgaagatacgcccggcgatctggttgctcgagttgtaaaccaacagtgtctgtacggcggggagtagtgcaccatcggcggcaccgagcaaaaaacgtaaaatcccaagttgcaatggcgtctgaacgtaagacattgggatcaacagcagtacagaaaagatcagcgctgtaatcaggatcttttcgggtccgattcgatcgccaagtttgccgagtcgtggtgcacttagcagagccgccacgcctggcaccgaggcgatcatgccactgataaaggcgacgttactgacgttacccgccagttcgcggacatacagcgtcagaatgggggcaattgagcccgtcgccacctggatgattaacgtagtgacaaacaggctgagtaccagtttcgggtttttaagtgatgtcaccacttcccgcatgtgcagcatctcttttttgctgaccggctggaatttttctctgatgcaaaacagggtgacgaaaaagcagagtatgagcacactggcggtaataaagaataccggacgtaagccgtagctatcggcgagcaggccgccagccattgggccgagcaacgcaccactaacgccgcctgtggagagcgtacccagcgcccagccgcttttattacgcggtacttgtgtggcgataagagcattagcgttggggacaaatccgccaagtaacccaagaagcgcccgcaggatcaaaaactgccagatattttgtgccagccccatcaacaccatcacgatgcccatgccgagggcagagcgtaatagcatgagttttcggcctttacggtcggcgagtccaccccaaaacggtgaggcgatggccgaaaataaaaatgtaatgctgaagacaataccggaccacatattcagggcggagtgaccggtaacgccaagctgctcaacgtagaggggtaagaagggcattaccagactgaaggcggcaccggtaagaaaacagcctagccaggcgacgatcaggtttcgtttccagtttataggggtgtcattttcacagggtgacatagcaatccgctgttggtgcgccaggcgcggtgaacataagaagaaaagataagcacactaattatgcgcccgacttccagggggcgcaatccagagagcttttatcgctaaatcagggggatttgctgtggtaatgccggatgccattctgaagcatccggcatgggagatttaatagcgtgaaggaacgccttccgggcgtgttttaaagcgacggtgtaaccacatatactgctctggtgccatcatgatgcatttttcgaccactttgttcatccacgcggcggtagtttcggcatcatccagtggcggagaacactctggcggcagcataatcaattgataccctttgccatctggcttacggcgtggaacgaagggcaccagacatgcgccggacatccgtgccagcatccaggttccggtcgtggtcgcagcctgctcaacggcaaacaacgggacgaaaacgcttgagcgcgggccgtaatcatgatccggtgcgtaccagaccacttcgccttttttcagggctttaatcatgccttttaaatctttgcggtcgagcatcgatttatttgagcgcaaacggccccaggtttgtagccagtcaatcagtggattatcgttcgggcgataaacgccaatacccggttcctgcataccaaactgccgcgcacccagctccagtgtcagaaaatggatgccaactaacaggatgccgcgtttttgcgcctgcacgtcacgaatgtgttccatgccgatcacttccgtccagcgggcgattcggcggtccggccagaaccacgccatgccggtttccatcaggcccatgccaacggattcgaaattcttcaccaccattttacggcgttcttgttcgctcatttccgggaagcacagttccaggttgcgatgcacaatttttgcgcgtcgtttcataaaacgtaacgccagttttcctaatccacaaccgaggcggtagataaccgggtagggcaattgcacgactaaccaaagtacgccaatacccaaccaggttaaccaataacgcggatgaagcagtgcggtggagaacttgggtagattcgtcatatcaatcctgtttttcaacctattcgggcaattgtatgtattgtcgcattttttcgcccgcaaccaaaatttgtggctgaagactgggcgaaattgccgcgcttgtaaataacaaataatttttaatgcgcaaatgtagcgtaaaatgtgtggatgttaattatcgataattgctatatcatgccgcggatttttactttcccatctcgcaggaaccgtacaccatgccagtgttacacaaccgcatttccaacgacgcgctaaaagccaaaatgttggctgagagcgaaccgcgaaccaccatttcgttttacaagtatttccacatcgccgatcctaaggcgacccgtgacgctttatatcagctgtttaccgcgctgaatgtttttgggcgagtgtatctggcgcatgagggcattaacgcgcaaatcagcgtacctgcgagcaatgttgaaacatttcgcgcgcagctctatgccttcgacccggctttagagggtttacgcctgaatatcgcgttggatgatgacgggaaatccttctgggtactgcgcatgaaggtacgcgatcgcattgttgccgacggtattgacgatcctcactttgatgccagcaatgttggtgagtatctgcaagcggcggaagtgaacgccatgcttgacgatcccgatgcactatttatcgacatgcgtaaccactatgagtatgaagtggggcactttgaaaacgcgctcgaaattccggcagataccttccgtgagcagctgccaaaagcagtcgagatgatgcaggcacataaagataaaaaaatcgtcatgtactgcaccggcggcattcgttgtgaaaaggccagtgcctggatgaaacataacggattcaacaaagtctggcatatcgagggcggaattattgaatacgcccgtaaggcgcgcgagcagggcttgccggtgcgttttattggcaaaaattttgtttttgacgagcggatgggcgaacgtatatcggatgagattatcgcgcattgccaccagtgcggcgcgccgtgcgacagccataccaactgtaaaaatgatggctgccacctgctgtttattcagtgtccagtatgcgcggaaaaatacaaaggttgttgtagtgagatttgctgcgaagaaagcgcgttaccgccagaagaacagcgacgccgtcgggcaggacgtgaaaatggcaataagatctttaataagtctcgtggacgtctgaatacaacactgtgcattcctgatccaacagaataaatatcattgccggatgcgtgccatccggcaacatttcacgcttacttctgctgtacgccttccactgaaataatcagatccacttcctgagaagctggacctaaatctgtcttgatattgaagtccttgagcttaattttgccttcggcctcgaagcctgcacgtttaccaccccatgggtcgtcgccctgaccaattaatttcgcttccagcgtgacgggtttggttacgccattcagcgtcagatcgccggtaatatccagttcgtcaccgtctttcttcacgctggtggaggtgaatgttgcctgtggatattttgcggtattgaggaaatctgcactgcgaagatgtttatcgcgttcggcgtgattagtatcgacgctggtggtgttaattgtcacattcactttatcggcagccggatttttttcgtcaaaggtaaaagtaccgtcgaaatctttaaaggtgccgtataaccagctatagccaaggtgctggatgcggaaattaacaaaggcgtgctgaccttctttgtcaattttgtaatcggcggcaaccgctgaaccggcagagaacatcagggacgcgaaggttaaaccaagcaggctttttttcattttttatactccatagtcagatgacgactttcccagcatgcgcttcagagtgtcgtctttatcgatgaaatgatgcttcagggccataaatccgtgcataacggacagtactacgacgctccacgcgagccaaaaatgcagggcaccggcaaagtctgcctgtgcgccagcgtcggcaagggtcgcggggacgtcaaaccagccaaaaacgctgatcggtttaccatcggcagttgagatcagatagccgctgatgccgatggcgaaaagcaataggtacaatgcgagatgtccagctcttgcggcaagacgagtcatgggcgaataactcggcagcggacccggcggtggagatatgacacgccacagaacgcgaataaccagccccatcattaacaaaataccgatgcttttatgcagttcgggtgctttgtgataccagccatcgtaataactgagcgtgaccatccacagacctaaagcaaacatgccgtagacaataattgcgcttagccaatggaaggccgcagatataacaccatagcgttcaggggtatttgtgaatgacataagtgcatccaaaacgaatttgcgagagaaagaaaatggcgtgtcggagaatgaattgcaacacaaaaataacaaattgaatgatatttatttttatttcaataattttgaattaataatgaaagaatcttcataagtttagtgggttcagcatcagagatgtctggtgagtgctgtagaagcaggaataatctcattcaatttttcacgctaaatgaaagggagattaaatatttgtcagtttatgtcagtgcggaaaactaaaaataaaacacatagatcagatccataattgccaacaatccccagagaaaaagataaagcatcagatgctcgcgaatattattgatgagatagtgcaacagccgacgcattaaatactcctgtaaaaacggcctcattctggaggccgtaatgatgattattggaagcgggaaagcctgaatggcgtcaaatcaaaatcgctttttttgtcttgcgcaaaatcggcagctatttcccctaaaactgacgcaaatttaaaaccgtgcccactcaggccggtaatgagcagtgtattatcgtggccgggtagggtatcgataataaaatcttcgtcaggcgaattatcataggtgcaggcagcgccgtacaggcagcaaccgatacccggcaatacattgcgcaagaacgggaaggcttctgacccatcactggccacttccgcaaacggaacacgttcatccgctgaatggataacctggcctccgttatgtttgccaatcttcaacgcgtcgttttctgccggaaaaccataatattgatcgccattgggcagttcaccggtaaacgccgggaatttattcttcacgctatagcggccatcggcctgataccaggcaaatactttgcgtacgggctggacaggcagctccgggagcaggtcttttacccatgttcccgcgcagacaatcgcttttttcgcctgatactcaccgtcagccgtttcaatagttacgccatcatcgtcatgacgaattgcggtgaccgggcagttgaacagttgcgcacagcccgcttccttcgccagttggatccaggttttaatcgccagttcgctgcgcaaaaaaccggaatcagtttcaaataagccgatgtagttgtccgggacgcgtatttccggccagcgggccataatcccttgcgcatcgagcttttcaacgttgagttgccattgttcggcgctgtgggcgacgttggcgagaaatgtggaatcagccgggccaaggttaatgacgccagagcgtacaaaaatgggatcttcttcgttgtggcgggagagttcatcccacagcgtttgcgcgcggaggaccagcgggacatacttttcgccttcaccataagcatggcgaattaatcgcgtatcgccgtggtggctgccgtgttgatgcggtggcatatgggcgtcggtcattagcacgtttaaaccggcgcgggttgcataatacccggcggcagcgcctacggaaccgctgccaataatgatgagatcgtatttcatttttttctctctgctctcatggtttaagcagagtaattaactgaatgcagatatacaacccagaaatggtaaaggcaccggtgaggtgccttttgggtggatggtcatgtcatgttaatgacgccgatactcgtttacctggaaatcaccggattcaattttggcgattcctgcttctaatatcgaaataaattgtctggcaacatcagtggttaaccagagcgtctgaccaacttcagtcccttcctgctcggacttatttggggtctggtagtgcaaacgcaacatcagcgcatcatagctatcaacggtgctgatgtcccaccctacgagcggatgagtctgaatgacttcattatttttttccatcatggccccctaattcgtgttactagacaacgttattcgaggttcaatgcgtttttatctgaagcaacttcagtataccaataagtaagggtattcaccgaatttttaaagggggaaacagataaatttctgcttttaagatttatatgaacaataaaacagcatgtcattcatatttttttagcatattgtgcaattattttgaggaagtgtagaaattttgtactcaaaattcgtaagtaaaataaaaaagccggggcgacccggcaaaaaaaatcactgcatattattcgctgacaaaccagtcatcggcgctttcccacgtttcctggagaatttcactaatgcgctgtttatcttcttttgtcgcgccaataaccgataaattattcgctgcggcataacgtaccgatacgtggccttcattatcaggaaacgcatactgaatacggcgggaaagttcgccagccagggcgtcaatagccccagctggcaatggagaagttttcgctatggtgacttcaattcgcataatagccccctgttgaatatactggttatttatacaggtaaaataacctaatgacaacaggaagctacgatttttattgtttaacggaccagcgtaccgtttccccggcgaggaatggcaccagcgtgtcatcagtcagtgcgatgctttcagcaacctgttgctcttcacgtaccagttcgatgaatgtgtcgttgaccggcaacccatagaactgcgggccgtttacagaacagaatgcttcaaagtgctgcaaagcattcatttcttcaaagacggtagcgtaactgcccagcgcggttggggcgttgaagcagcccgcgcagccgcaactgctctctttgcgatgacgtgcatgtggcgcagaatccgtaccgaggaatactcgattaaaaccgctggcgaccagttcacgcaatgcctgttggtgaatattacgtttgaggatgggtagacaatacaggtgcggacgcacgcctccaaccagcatatggttgcggttaaacatcagatgctgcggagtgatggtggcagccagccgttcatttccgtcacggacatagtcggcagcatctttggtggtgatgtgctcaaaaacgactttcagcgcagtcaggcgctggcgcagaggttccatcacgctttctataaagcgcgcttcacgatcaaaaatgtcgatatctgcatgtgtcacttcaccatgcaccagtagcggcataccgattttttccatgcgctcaagtaccggcatgattgcgtcaattgacgtcacgccgtggctggagttagtggttgcgtttgccgggtaaagttttgcagcggtgaacacgccttcgttaaatccgcgctccagctcattaggatccagcgaatctgttaaataacaggtcatcaatggggtgaaatcgtgcccggcaggtacggcgtcaagaatacgctggcgatacgccacggcagcctcaacggtggtcacgggcggagccagattgggcattacgatagcccgtccataaatttcgctggtatatggcacgacagtttttaacatgtcgccatcgcggaggtgaaggtgccagtcgtctgggcggcggatctttaatacctgggatggtgcagtcattaatctctatgctccggctgaagggatgtttttgccggacacaaaggataagcggaaacgttttcctttgcacgaaaaataaagggcgcgaatgcgccctcgtgattaatcagtaaatggaatgacaatttcgcctggcttcacttcaatgcctttcgccagttttttcgccattgcttcgccctggctgccatcttcgcgcaggacgtaagcaggttgctggttaaagtaattgcgtaatgcctggttcaaatagggaagcaacgtttgcatcaccgtttgcattttttccggttgtaccgtcgcatcgaccacttccatctctttcaggaagatcgcacctttttctttatcaaacacgggcagcgctttcagcttcagtttcatggtcgctttctgactaccgaacagggagttcatgtccagattggcgtctccggttagggtaaccttattcggctcttcgcgaccaatttggctggtcaggtttgtcagaacaatatgggcgtcagccacgccgggtaaaccgatatcttttgagaaattattatgtttcgcaagcgactggttaatttcttgttcggtgatggtgtattgggtgagttgattacagccaacgagcaggccactgacgatcaatgcagcggcaaataaaaacttgttcatggtagtcctcgacatgaaatctgcgtcaatatcctgacacaacgcagcatgtgtcaccagcgataaactcgccagcagaaaaaactgaaaacggcggcaacccgcgaatacaggctgccgcggcgggtcaggattaaatcgccattgatgataacaaattgatttgtgtctgtttcgccatattatcgcggtaatcagcaacgcggcttggccagttaattccggctaccagcgtcagattacgcagtagcgggaatagctgaatatcatcttccgaaagttcgccattcacggcgttcggtttgacgatcagtttgtccagcgcacgtaaatcatcgctgatattcttaatcagaccgtcagagtgggccagcaggtcggcaaaattacccgcgctggcctctttcttgtcgacgaaatatttgcgcgcggcgggagtagaaaactcatcaaatgccgatttggcaaaacgcggcaacagcagtttgttggcgtagccattgaccttgcgcagccactcttcaatggcaggggaacgtttgccggtcagtaacggtttgccgtcgagtttatcgacatagtgaacgatgtccatgctttctggcatatagcggctgtcatctttttgcagaatgggaacctgtttttgaccgaccatccgggtgggtgtttctgcgtcgtcgttgagcagaacatgtaattcgacggggatatttttcaggccgaaaatcatgcgggctttgaggcagtaagggcagtgatcgtaaatgtatagcttcacgtgactcctccatttggctgtcagttcactttcagtatgaaggagtcaggggggagtatcaaatcaggcgtcgcgttcaagcaaacgacgcgcggcgcgtttctggctaaactgccaacccagcgcaaggaaagtgaagatgccaataatgcccagcatcatccacggaagctctggctggtgcgccgatttgcccaggtcaaacagccagccgccaccgatataaccaatagcgccgccaatcgccagacccagacggctaaaccccatatagctgccgcgagctcttgcgtccgccagcgaagcacttaaggtttcacgcgcaggctcggcaatgatcgacccgatataaaacagacaaatcagggtgaaaagttgttgcaggccgctgaccatgcccaccggcatcatgcttaatgacattatcaacagcccagccatcaaccggtgttccagacgaaaatgcttttcactccagcgggcgatagggtagagcaacgttaacgacagacacgcttcaatggcatacatccatttaacggcagagggcgcgccagccacgtcgttgaccataattggcagcatcagcatcacttgtacagccagcatgtagtaacccgccagcgtcagaacataggtgacaaaacgcttgtcacgcatcacgcgggtcatgccttcgcgaacgggcgtgcgtacggtggagagtttccatgctggtaacaaccacgcattgaacgccgcacatagcacaaatagaactgcccctgtggcgcagaccaggcgaaagtcgtattgcaacagccagctccccaacaatgcgccaatgaccgcaccggcactgtcctgcatcatcaacagcgagaaaaaacgaccacgctgctgtggacggattaatttcaccaccagcgccgaacgcggcggatcaaacaacgtgccaccgagtcccgagagcaggcatgaaaaccacaatagccacggttcgtgggcgatacccattgtggcgaatccggcggcgcgcatcagcataccggtaacaatcatcggtttggcaccaaagcggtcggcaattgcaccgccgaaaatacccagaccttgctgaataaattggcgtagaccgagagcaataccgaccatgacggcggcccagcccatttgatcaacgaagcggatagagatcagcgggaagacaacaaagaaccccagcacgaccagcatattatcgatgagcaggaaatatttacccaggttcctcgcctgcgacacgcgggacatttcccctcccgggaaataaaagatgagcactttctattctgcattgccgctaagacttttcccatcacttcggggacaatatttttttatcaaaacgtcgctttgatagagagtttttatcaaatatgtgaataatgcagaaaatggcattttggacttttcacagggtctggttgcgcaggtatagtaatacttacagcgtattaaagacgttacgggaaggagtaggtatagaatgtttggctatcgcagtaacgtgccaaaagtgcgcttaaccacagaccgactggtcgtgcgtctggtgcatgatcgtgatgcctggcgtcttgcggattattacgcagagaatcgccatttcctcaagccctgggagccagtgcgcgacgaaagccactgttatccatcaggctggcaggccaggctggggatgattaacgaatttcataaacaaggttcagctttctactttggcttattcgacccggacgaaaaagagattattggcgttgccaatttttccaatgttgttcgtggctcttttcatgcctgctatctcggttattcgattgggcaaaaatggcagggcaaaggactcatgtttgaagccctgaccgcagccattcgttatatgcagcgcacccaacatattcatcgcattatggctaattatatgccgcacaataaacgcagcggtgatttactggcgcgactgggttttgaaaaagaaggctatgcgaaagactatctgttgattgatggacaatggcgcgatcacgtactgacggcattaactaccccagactggacgcccggccgctaaggagaatctcatgaaatatcaacttactgcccttgaagctcgcgtgattggttgcttgctggaaaagcaggtgaccacgccggagcaatacccgctctcagtcaatggtgtagtcacggcctgtaatcagaaaacgaaccgtgaaccggtcatgaatctgagtgaatccgaagtgcaggaacagctggataatctggtcaaacgtcattatctacgcacagtgagcggttttggtaatcgggtcaccaaatatgagcaacgtttttgtaattcagaatttggcgatctgaaactgagcgcagcggaagtggcgttaatcaccacgttgttattgcgtggtgcccagacgccaggtgaactgcgcagccgcgccgcgcgaatgtatgaattcagcgatatggcggaagtggagtcgacgctggaacaactggcaaatcgcgaagatggtccttttgtggtgcgtctggcccgcgaaccgggtaaacgcgaaaaccgctacatgcatcttttcagtggtgaggttgaagatcagccggcggtgacggatatgtcgaacgcggttgacggtgatttacaggcccgcgtcgaagccctggaaatcgaagtggcagaactgaaacagcgtcttgattcgttgctggcccatctgggagattaaagtgaaaaaattacgtatcggcgtagtgggattaggtggcattgcgcaaaaagcgtggttaccggtgctggcggcagcgtctgactggacgttacaaggagcctggtcgcctacgcgcgcgaaagccctgccaatttgtgaaagctggcgcattccttatgccgattcgttatccagccttgccgccagttgcgatgcggtttttgtgcattccagcaccgccagccactttgacgtggtcagtacgttactcaatgcgggggtacatgtctgtgtcgataaaccgctggcagaaaatctgcgcgatgctgaacggctggtggaactggcggcgcggaaaaaactgacgttgatggtcggttttaaccgtcgtttcgcaccactctacggtgagttaaaaacgcaactcgccaccgcagcctcgctaagaatggataaacatcgtagcaatagcgtcgggccacacgatctttatttcacgttgctggatgattatctgcatgtggtggataccgcgctgtggttgtcgggcggcaaagcctctctggatggcggtacgctactgactaacgacgctggcgaaatgctgtttgccgagcaccatttttcggctggtcctttgcagatcaccacctgtatgcatcgccgtgccggaagtcagcgtgaaaccgtgcaggccgtgactgacggtgcgctcatcgacattacggatatgcgcgaatggcgtgaggagcgcgggcagggcgtagtgcataaaccgattcctggttggcagagtacgcttgagcaacgtgggtttgtcggctgtgcgcggcacttcattgaatgtgtgcaaaaccagacagttccgcaaaccgccggcgaacaggccgtgctggcgcaacgtatcgttgacaagatctggcgcgatgcgatgagtgaataaaccctgtaacatctggcggtagcaattcaccataatccaggtagactattcgcctctttcagcgcctgccttgcaggcgttttgcccgtgggtctggattagaacaccgatgaatttattaaaatcgctggccgccgtcagctcgatgaccatgttttcgcgtgtgcttggcttcgcacgagacgcaattgtcgccagaatctttggcgcagggatggcaaccgacgcctttttcgtcgcttttaaacttcctaacttgttacgccgtatctttgccgaaggggcattttcccaggcatttgtaccgattctggcggaatataaaagtaagcagggtgaagacgccacgcgggtctttgtctcttatgtttctggcctgctgacacttgcgctggcggttgtgacggtcgctggcatgctcgccgcaccgtgggtgatcatggtgaccgcgccaggcttcgctgacacagctgacaaatttgccctgaccagccagctactaaagattacctttccctatatcttgctgatctccctggcgtcgctggtgggagcgattctgaatacgtggaaccgcttctcgattccggcgtttgctccaacactgcttaacatcagcatgattggtttcgcgctgtttgccgcaccgtactttaacccaccggtgctggcgctggcgtgggctgttacggtcggcggcgtcctgcagctggtgtatcagctaccgcacctgaagaagatcggcatgctggtcctgccgcgcattaacttccacgatgccggagcaatgcgcgtggtgaaacagatgggaccggcgatccttggcgtctctgtgagccagatctccttaatcatcaacaccatttttgcctcgtttcttgcttccggttcggtgtcttggatgtattacgccgaccgcttaatggagtttccgtccggtgtgctgggcgtggcgcttggcaccattttgctgccgtcgctgtcgaaaagttttgccagtggcaatcatgatgaatacaaccgtttgatggactgggggttgcgtctttgtttcctgttggcgctgccgagtgcggttgcgttgggcattctttccggtccgttgaccgtttcgctgttccagtacggtaaatttaccgcgtttgatgcgctgatgacccagcgggcgttaattgcctactcggtgggtttgattggcctgattgtagtgaaagtgttggctcctggcttttattcccgccaggacattaaaacgccagtgaaaattgccatcgttacgctgattttaacgcaattgatgaacctggcgtttattggtccgttgaaacatgccgggctgtcactttctattggtctggcggcgtgtctgaatgcttcgctgctttactggcagttgcgtaagcagaaaatctttaccccgcaacccggctggatggcgtttctgttgcgtctggtggtggcggtactggtgatgtctggcgtgcttttaggtatgttacatatcatgccggagtggtcattgggtaccatgccctggcgtttactgcgtttaatggcggtcgtgctggcggggattgccgcgtacttcgctgcactggcggtactgggcttcaaagttaaagaatttgcccgccggacggtgtaacaatgcattccggcctgcagtgcaggccggagataatcttcagatcgaaatctttttaccgccgcgatgggttgttgaggtctgaccgttcgccccatatagcgtcggttcctgatgcggtttcaacatttccagcgcctgttgattgcgctcaatctgtccttccagtaaccagccgttatgttgattcatttggcgtagttgctgcgttttcacagtaatttcctgccagcgttgactaatatcaacgctatttgctgtattgggttctttcctgcgtaactgttcgaggtaatccagcgtcgccagcagtgagcttttttgttctgtaatccattgcaactggctgccgttgatctgccccatagagagatgttgctgctcttgatccattaccgttttgagatcgttaagcacagcggacatctggtcgaggatctctgcaagacgtgtcatacgatcagttactctgcaagtcttgctgcgcttcgttgatcagcgcatcggcaattttgccggtgtccatttttagttcaccgttacgaatcgccagttttaacgcttcgacacgttcaagattgatatcactgctgccgggttgcatcagttttgcttgcgcgtcgcttaacgtcacactggtgctggtggaggcggttgtttttgccgcccggctgttcgttaccggcgcgtcagtggtttcgcgcggttgaacggtgcttacaggcttcagaggcgaagtgcgatcaatactcatggtttattcctcattgagggcgcttttatcatgtgttgcttatttatcggcaagggacgggtaatctttaacagcttacaggtttataagaatattcccatctgcatcaacaacgccgctgactacctgtcccgataccatgcgcacccgcgcattctgtgcgacggctgcattgttcagcgcctgaccttctgcgttggcgctaaacccatcaccgctggcgatcacattgacgcgttgtcccgcttttacccgccatgcctggcgaaactgggttaactggataggttgatcgggtgatagatcgcgcaggctaatggcatcaacaagttgattgatatccagcaccgtacgcggtggcagggtatccagccgtccgcgtttcagtttgacattgccagcttccagctttcctccccgcgcaatgggcatcgcggcaaccacataatttcctgtggcctgtacattaacctgtaaatatcgtttgtcgttaccgcagcgtgccaacacattcacattgccccacaggcgggaattattgctcatcgaaagcaatggctgctcgcatggcggtagtagattgggcgctgtacgaatagaaacacgaacctcatcacttacccccgcgagttgggcgctaaaaaagttgtgcaattgcgatgtgagattgctcgccgtacttaacggactgaacagtatcgcgatgatcgccacgctacgttttattatcagcattttcgcccccagccatttctacaacgtgaattgtacctgtccgcaatgaccatcaacggcataaatagcgacccattttgcgtttattccgccgataacgcgcgcgtaaaggcatttaagctgatggcagaattttgatacctgcggaggagatatgctcgataagctcgacgccgccttacgttttcaacaagaggcgctcaatctgcgcgcccagcgtcaggaagtgctggcagcaaacatcgccaatgccgatacccctggttatcaggcgcgcgatatcgattttgccagtgaacttaaaaaagtcatgcaacgtggacgggatgcaaccagtgtggttgcactgacgatgacctcaacgcaacacattccggcgcaggcgctgacgcctcctaccgcagaactgcaataccgtattccggaccagccttcgcttgacggtaataccgtcgatatggatcgcgaacgcacccagtttgccgataacagcctgcaataccagatgagccttagcgcgttgagcgggcaaatcaaaggcatgatgaacgttttacagagcggaaattaacggatggcactgctgaatatttttgatatcgccgggtcggcgttaactgcccagtcccagcgcctgaacgtggcggccagtaatctggcgaatgctgatagcgtgaccggtcccgatggacagccatatcgggcaaaacaggtggtattccaggttaacgctgcaccaggtgctgcgacaggcggcgtaaaggttgccgatgttatagaaagtcaggccccggacaaactggtttatgaaccgggtaatccgctggcagatgcaaagggctacgtaaaaatgccgaacgttgatgttgtcggagagatggttaacaccatgtcggcgtcacgcagctatcaggccaatgttgaagtgctcaacacggtgaaaagcatgatgctgaaaacccttacgctcggtcaataaaggagaaagctatgtccattgcggtaaccaccaccgatccgacaaataccggcgtcagtaccaccagcagtagttcgctcacgggcagcaacgccgcagatttacaaagcagttttctgactttgctggtggcgcagctgaaaaaccaggacccgaccaatccaatggaaaacaacgagctgacgtcgcaattggcacaaatcagcacggtcagcgggattgaaaaactcaataccacgctcggatctatttccggacagattgataacagccagtcgttacaggccagtaacctgatcggtcacggcgtgatgatccccggcaccactgttcttgcgggaaccggcagtgaagaaggggctgtgaccacgaccacgccgtttggtgttgagctgcaacaggcggcagacaaagttacggccaccatcaccgataaaaatggcgcggttgtgcgcaccattgatattggtgaactgaccgccggagttcacagtttcacctgggacggtacgttgactgatggcagcactgcgccgaacggttcttacaatgtagcgattagcgccagtaacggtggtacacaactggttgcccagccgctgcagtttgctctggtgcagggtgtgatccgcggcaacagcggtaatacgctggatctcggcacttacggcaccaccaccctcgacgaagtacggcagataatttaagccttcacatttcaggagtcagtcatggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcactcaggactttaccgatggcacgaccaccaacaccgggcgaggtctggacgttgctatcagccagaacggttttttccgtctggtagacagcaacggttcggtgttctacagccgtaacggacaatttaagctggatgaaaaccgtaacctggtgaatatgcaaggtttacagctgacgggttacccggcaaccggtacgccgccgactattcagcaaggggcgaatccgaccaatatttcgatcccgaataccctgatggcagcgaaaactaccaccacggcatcgatgcagatcaacctgaattccagtgatccgcttcctactgttacgccattcagcgccagcaatgcggatagctataacaaaaaaggttcggtgactgttttcgacagtcagggtaatgctcatgacatgagcgtctactttgtgaagaccggggataataactggcaggtctacacccaggatagcagtgatccaaacagcattgcgaagacagcgacaacactggaatttaatgctaatggcacattagtggatggtgcgatggcgaataatatcgcaaccggcgcaattaacggtgcagaacccgccacgtttagtctgagcttcctcaactccatgcagcaaaataccggcgctaacaatattgtggcaaccacccagaacggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtctgcgacgcaatcttctggcgtggcgctgttggggacagccgggacgggaaactttggcaccctgaccaacggtgcgctggaagcgtccaacgtcgatctcagtaaagaactggtcaatatgatcgttgcccagcgtaactatcagtctaacgcccagaccatcaaaacccaggaccagatcctcaacacgctggttaacttacgctaatcgctgacgggatagctcaatggatcacgcaatttataccgcgatgggagcagccagccagacactgaatcaacaggcggtaaccgccagtaatctggccaatgcctcaacgcccggttttcgcgcgcagttgaatgctttacgcgcggtgccagtggaagggctttctctgcccacgcgcacgttggtcacggcgtcaacgccgggcgcagatatgacgcccggcaaaatggattacacctcgcgcccgctggacgtcgcgttgcagcaggatggctggctggccgtgcagaccgctgacggcagcgaagggtatacgcgtaatggcagcattcaggttgatcccaccgggcaactgacaattcaggggcatccggtgataggcgaggctgggccaattgctgtgccggaaggggcggaaatcactattgctgccgatggcacaatctcggcgctcaatccgggcgatccggcaaatacggttgcgccagtagggcgtcttaaactggtgaaagccacgggcagcgaagtgcagcgcggtgacgacggcatttttcgtttaagcgcagaaacccaggccacgcgtgggccggtactgcaggcagatccaaccttgcgtgtgatgtcgggggttctggaaggcagtaacgtcaatgccgttgcggcaatgagcgacatgattgccagcgcgcggcgttttgaaatgcagatgaaggtgatcagcagcgtcgatgataacgcaggccgtgccaaccaactgctgtcgatgagttaattgaaaggatacatgacaagtataagttgcccgatgcgcaagtttatcgggtctatgggggcaatcgcaatttatcgattttgcgagcacttgtaggccggataaggcgtttacgccgcatccggcaagaagacatatgcactttgtcactaatccactacaggacattttatgatcagttcattatggatcgccaaaacgggccttgacgcccagcaaaccaatatggacgtcattgccaacaacctggcaaacgtcagtactaacggttttaagcgtcagcgcgcggtgtttgaagatctgctttatcaaaccattcgccagccgggggcacagtcttccgaacaaaccaccttaccctccggattacaaatcggcacgggggtacgcccggtcgccactgaacgcttacacagccagggaaacctgtcgcagaccaacaacagcaaagatgtcgcgattaaagggcagggctttttccaggtgatgttgccagatggttcatcagcctatacccgtgacggctctttccaggtggatcagaacgggcagctggtgacggctggtggttttcaggtgcagccagcgatcaccattccggcgaatgcgttaagtatcaccatcggtcgtgatggcgtggtcagcgtaacccaacaaggccaggcagctccggttcaggttgggcagctcaatctcaccacctttatgaatgacaccgggctggagagcattggcgaaaacctctacaccgaaacgcaatcctctggtgcaccgaacgaaagcacgccgggcctgaacggcgcgggactgctgtatcaagggtatgttgaaacgtctaacgtcaacgtggcggaagaactggtcaatatgattcaggtgcaacgcgcttacgaaatcaacagtaaagcggtgtccaccaccgatcagatgctgcaaaaactgacgcaactctaaggcttaaccggtggcaggttcaccggtttactgatttttgaagatgatagccatgcaaaaaaacgctgcgcatacttatgccatttccagcttgttggtgctttcactaaccggctgcgcctggataccctccacgccgctggtgcagggggcgaccagtgcacaaccggttcccggtccgacgcccgtcgccaacggttctattttccagtctgctcagccgattaactatggctatcaaccgctgtttgaagatcgtcgaccacgcaatattggcgatacgctgaccatcgtgttgcaggagaacgtcagcgccagcaaaagctcctctgcgaatgccagccgtgacggtaaaactaattttggctttgatactgtgccgcgctatttgcaggggctgtttggtaacgctcgtgccgatgtcgaagcctccggtggtaacacgttcaacggaaagggcggggccaatgccagcaatacctttagcggcacgttgacggtgacggttgaccaggtactggtcaacggcaacctgcatgtggtgggtgaaaaacagattgccattaatcagggtaccgaatttattcgcttctctggcgtggttaatccacgcactatcagcggcagcaataccgtaccgtctactcaggtggcggatgcgcgcattgaatacgtaggcaatggctacattaacgaagcgcaaaatatgggctggttgcagcgtttcttccttaacctgtcgccaatgtaagtgaggctgtggtgattaaatttctctctgcattaattcttctactggtcacgacggcggctcaggctgagcgtattcgcgatctcaccagtgttcagggggtaaggcaaaactcactgattggctatggtctggtggtggggctggatggcaccggtgaccagacaacccagacgccgtttaccacacaaacgcttaataacatgctctcacagctgggaattaccgttccgacgggcaccaatatgcagctaaaaaacgtcgctgcggtaatggtgacagcgtcacttcctccgtttggacgtcaggggcaaaccatcgatgtggtggtttcttccatgggaaatgccaaaagcttgcgtggaggtacgttgttgatgacaccgcttaagggcgttgacagtcaggtgtatgcgctggcgcagggcaatattctggttggcggcgcaggagcctccgctggcggtagcagtgttcaggttaaccaactgaacggtggacggatcaccaatggtgcggttattgaacgtgaattgcccagccagtttggcgtcgggaatacccttaatttgcaacttaacgacgaagatttcagcatggcgcagcaaatcgctgacaccatcaaccgcgtgcgtggatatggcagcgccaccgcgttagatgcgcggactattcaggtgcgcgtaccgagtggcaacagttcccaggtccgcttccttgccgatattcagaatatgcaggttaatgtcaccccgcaggacgctaaagtagtgattaactcgcgcaccggttcggtggtgatgaatcgcgaagtgaccctcgacagctgcgcggtagcgcaggggaatctctcagtaacagttaatcgtcaggccaatgtcagccagccagatacaccgtttggtggtggacagactgtggttactccacaaacgcagatcgatttacgccagagcggcggttcgctgcaaagcgtacgttccagcgccagcctcaataacgtggtgcgcgcgctcaatgcgctgggcgctacgccgatggatctgatgtccatactgcaatcaatgcaaagtgcgggatgtctgcgggcaaaactggaaatcatctgatgatcagcgacagcaaactactggcaagtgcggcctgggatgcgcaatcactcaacgaactaaaggcgaaagcgggcgaagatccggcggcaaatatccgtccggtggcccgtcaggtggaagggatgttcgtgcagatgatgttgaaaagcatgcgcgacgctttaccaaaagatggcctgttcagcagcgagcacactcgcctgtataccagtatgtatgaccagcagattgcccaacagatgacggcgggcaaaggtctggggcttgcagagatgatggttaaacagatgacgccagaacaaccattgccagaggagtccacgccagcagcaccgatgaaattcccgctcgaaactgtggtgcgttatcaaaatcaggcgctttcgcagctggtgcaaaaggccgtgccacgtaactacgatgattcgctgccgggtgacagtaaagcattcctcgcgcaactctcgctgcccgcccaactggcaagccagcaaagcggtgtgccacatcatttgatcctcgctcaggcggcactggaatctggttgggggcaacggcaaatccgccgcgaaaacggcgagccgagctataacctgtttggtgtcaaagcctctggcaactggaaagggccagttactgaaatcaccacgactgaatatgaaaacggcgaagcgaagaaagtaaaagcgaagtttcgcgtctacagctcgtatctggaagccttgtcggattacgttgggctgttaacgcgtaacccgcgctacgccgccgtgacgaccgccgcgagtgcggaacagggggcgcaggccctacaggacgcgggctatgccaccgatcctcactatgcccgcaaactcaccaacatgattcagcagatgaaatcgataagcgacaaggtgagcaaaacctacagtatgaacattgataatctgttctgaataactcaagtccggcgggtcgctgccgataatactctgtaattgaaggcttataaggaacctccatgtccagcttgattaataacgccatgagcggactgaacgcggcccaggcggcgttaaatacggcaagtaataatatctccagctataacgttgccggatatacccgccaaaccactattatggcgcaggccaatagcacgttgggcgctggcggctgggttggcaatggtgtctacgtttctggtgtgcagcgtgagtatgatgcgtttattaccaaccagttacgtgcggcgcagacgcaaagtagcggtctgactgcccgctatgagcagatgtcgaaaatcgacaatatgctctccaccagtacctcttcgctggcaacacagatgcaggatttcttcaccagcctgcaaacgctggtgagtaacgcggaagacccggcagcgcgccaggcgctgattgggaaatcagaaggattggtgaatcagtttaaaaccaccgatcaatatctgcgcgaccaggacaaacaggtcaatatcgcgataggtgccagcgttgatcagatcaacaactacgctaaacaaattgccagcctgaacgatcaaatctcgcgcctgacaggcgtgggggcaggggcgtcacctaacaatctgctggatcaacgcgatcaactggtgagcgaattaaaccagattgttggtgtagaagtcagcgttcaggatggcggcacttataacatcacgatggccaatggttactcactggttcagggaagtacggcgcggcaactggcggcagttccttccagcgctgacccttctcgtacgactgtcgcttatgttgatgggacggcaggcaatattgagatcccggagaaattactgaataccgggtcgctgggcggcattctgacattccgttctcaggatctggaccagacgcgtaatacgcttggacaactggcgctggcatttgccgaggctttcaacacccaacacaaagccggatttgatgctaacggcgatgccggtgaagatttctttgctatcggtaagcccgcggttctgcaaaacacgaaaaacaaaggtgacgttgcgatcggtgccacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgctgaaaccagtaagtgacgccatcgtcaacatggatgtattaatcaccgacgaagcgaaaatagcgatggcgagcgaagaagatgcgggtgatagcgataaccgcaacggtcaggccctgctggatctgcaaagcaacagtaaaacggtgggcggtgcgaaatcctttaacgacgcttatgcctcgttagtgagtgatatcggtaataaaaccgcgacgttgaaaaccagtagcgccacgcaaggtaatgtggtgacgcagctttccaatcagcagcagtcgatttccggtgtcaatctcgatgaggagtacggaaatctgcaacgttttcagcagtattacctggcgaatgcgcaggttctgcagacggcaaacgcgatttttgatgcgctgattaacattcgctaaggggagataagatgcgtttcagtacacagatgatgtaccagcaaaacatgcgtggtatcaccaattctcaggcagaatggatgaagtacggcgaacagatgtcgacgggtaagcgagtcgttaacccttctgacgatcccattgctgcatcacaagccgtagttctctcccaggcacaggcgcaaaacagccagtacacgctggcgcgtactttcgccactcaaaaagtgtcactggaagagagtgtacttagccaggtcaccactgctatccagaatgctcaggaaaaaattgtctacgccagcaatggcaccttgagtgacgatgaccgggcctcgctggctacggatattcaggggcttcgtgaccagttgctgaatctggcaaacaccactgacggtaacgggcgctacatttttgccggttataaaacagagactgcgccgtttagcgaagagaaagggaaatacgtcggtggagcagaaagtattaaacaacaggtcgatgcttcgcgttcgatggtgatagggcacacgggtgacaaaattttcgacagtattaccagcaacgcggtagcggaaccagacggtagcgcttctgaaaccaatctttttgccatgctggatagtgccatcgcagccctgaaaacgccggtcgcggatagcgaagcggataaagaaaccgccgctgcggcgttagataaaaccaaccgcggactgaaaaactcgctgaacaatgtgctgactgttcgcgcggaattaggcacgcagctgaacgaactggagtcgctggattcattaggtagcgatcgcgctttagggcaaacgcagcagatgagcgatctggttgatgtggactggaatgcaactatttcatcttacatcatgcagcaaacggcattgcaggcatcgtataaagcatttaccgatatgcagggattgtcgctcttccagctcagcaaataatttcgctttaaaacatatcatgaaactgggtatgttttgtctgcctgctctgggatcgctggggcgggcatttttttgcctattttgcattgttggttagcaaggatgccattcgatgaattttaatatgttgattcaaagatgaaataaaaaagccctggcagttaccagggcttgattactttgagctaattattactcaacaggttgcggacgcgcaggagcggcagaggcatgatgtgttgccgtatgaccacctgcggcacctttaccttcgaaggcaaaagtagggcgctgccagtcactgtgacgcggtgcctccggaacatattccggtgctggagcgcgcgtcattggcgcggtagcgtggttatgctcaacggtgacctcaggttcgaccgcagctaccgtttcaacttctgctgcgacttcagcgactactggcgcggcaggttgagcaacaacttcaggttcagcaactacaacctcagcagtttcgacaacttcttcaatatctgccgtctcttcctgcggttcaaccaccggttctgcttgttctgcaacttcctgggctacggcaacatcagactcggtaatcacctgcggctgttcagttaccgcggcagcgatcacttcaggatgcgtcgtttcaaccacttccggttgcggttcggcaacctgaacgggggcttctacgacaccggccacttcttcaacaactggcgcgctaacaaccggttcgatagcggcggcgacagggacctcagtcaccatcggctgcacatgtacttcttcctgttcgcgctgctcttcaacctgtacatcttgcggacgtacaattggatagcggatccagactttgccagaggccagttccggagacgcgcacgctacggtcaacggcattggcgactgggttggataacgctcgtcacgatagcgacgacgacgctgaccacttacgcgcaggtgacgaggcgagcggcgagaacgacgcggcatgccaccgttgtcacggttatcagcattgttctcttcttgctgttctggtgcagtttgcgctacgactggcagcgggactttcaccagttctgtgcgtggagctggcgcttcctgaacaattggttcggcagcgacagtttcttcaaccaccggtgcgactaccgcttcttcggctacgctttgctcgtaacgcactttctgattgagctgacgctgtttacgacgcggctgaaccggacgtacacgttcttcctgttcggtttcctgaacagattgctcttcaacattcagcgccttcgcttcttgttgcgcctgacgtttatcatcattacggcggcggctacgttcacgacgcggcgcttgctgctcgtcggcggtacgcgctttttccgttacctcagcctgctgacggctctcacgcgtctcggcagtctgctgctgtgcctggcgacgattacgacggttttcttcgcgattatcgctgccttcagtacgttcactacgggtgtcgcggcgctcattacggtcacggcggttgttctgacgaggcttgcgacgatcctgttgacgttccggtttcgcttctgctttcggtgctggttgctcggtcggtttggtttcttcaccaccgctgaacagcgctttcagtgcgccgaagaagcggctcaacagcccaggttgtgcaggagctgctggtgttgccggtgcagctttcggtgctggagctacaacaggcgcggcaggttcagctggcgttggcgcaggcggcacatccggcatggcaaaggttgccagcgcaggttgttccggacgcttacgttcagcgaactcttcttcagacggcagcgccatcgcttcttcatgcagcttcggcagcatgtagcttaaggttggggtttcttcccctttacgcacgcgcagcacgtggtagtgcggggtttccatctgatcgtttggcacaattacacagcgcacaccgtcctgacgagtttcaatggcatttaccgcagaacgtttttcattcagcaggtaagaagcgattggcacaggaacaatggcgtgaacttcctgggtgttctctttcagcgcttcttcttcgatcagacgcagaatagagagcgacagcgattcgttgtcacgcacggtgccagtaccagaacaacgcggacaaacgtgatgactggattcacccagtgatgggctcaggcgctgacgggacatttccagcaggccaaagcgagaaatatggctgatttgaatacgcgcacggtcctgacgcaccgcttcacgcagacggttttctaccgcacgctggtggcgtactggcgtcatgtcgatgaagtcgataacaatcaggccgccgaggtcacgcaggcgcagctgacgagcaatctcatcggcagcttcgaggttagtgttaaacgcggtttcttcgatatcgccgccgcgggtcgcgcgtgcggagttgatgtcgatggccgttaacgcttcggtgctgtcgataacaatggaaccaccagacggcagacgaacttcacgctggaaggcggactcgatctgtgactcgatctggtagtggctgaacagcgggatctcgccggtgtacagtttgattttgctgctgaaatccgggcgacctaatgcagcgatatgctgacgtgccagttcgagcactttcgggttatcgataaggatttcgccgatgtcctgacgtaagtaatcgcggaatgcgcgaacgattacgttgctctcctgatgaatcaggaacggggccgggcggctttcagcggcttttttgatggcttcccagtgtttcagacggaagcttaaatcccattgcagcgcctcagcagatttgccgacgccagcggtgcgcacgataagccccatgccttccggcagttcaaggcttgccagtgcttcttttaattcggtacggtcgtcgccttcgatacggcgagaaatgccacccgcgcgcgggttgttcggcatcagaaccagatagctacccgccagactgataaaggtggttaatgccgcgcctttgttgccgcgctcttctttatcgatctgaacaatgacttcctgaccttcacgcaacacatctttaatgttgggacgaccatgagcactgtagttagcagggaaatattcgcgggcaatttcttttagtgggaggaaaccgtgacgttcagcgccgtaatcaacaaaagcagcttccagactcggttcaatgcgggtgattttacctttgtagatgtttgcctttttctgctcgtgccctggactttcgatatccaggtcatacagacgctgcccatctacaagggcaacgcgcaactcttcctgctgagttgcgttgattaacattcttttcatcgtaacttactcattattcttacattgacgactaagctgcgggcaaagtaacgcctttccgggtgtgaaccgatggcctcgtgtctagtcgcgtcgccaacctcacggttatcgtcagctcaaagaggcgcagagtgtcggttgcccgtttttcatgcggaaaaacagcgcaattatcaaagaaacagactgggtattactctccagaaatatttccatctaccggtaaggactgcaacccgcagcccgctaactgcctgaaagatcaatacgtcttacgccattgctgcgtggatgatcggtcgggcaaaatgggttattccgtaaaatttcttgttttaacaaggatggacacggaaacggcctcattattccactgcaagccttgttatagcaagatgacttttaccatttatcacccgcttactcacagttttttcacttcttgctggtgattggtttaataaccatcaataaagtgatcacgcagtgaagtaataaggtgcaaaagtaaatataagcatagaaaaatgagtggcgcgaatcctgttggctaattagaatcgccaaccatgaaaacagagactccatccgtaaaaattgttgctatcaccgctgacgaagcggggcaacgtatcgataactttttgcgtacccaattgaaaggcgtaccaaaaagtatgatttaccgtattttgcgtaaaggcgaagtgcgggtgaacaaaaaacgtattaagcctgaatataaactcgaagcgggtgatgaggtgcgtattccaccggttcgcgttgctgagcgggaagaagaggcggtttcgccacatctgcaaaaggtggcggcgctggcggacgtcatcttatatgaagatgatcacatcctggtgctgaataaaccttccggtacggcggtacatggcggcagtggtttaagcttcggcgttattgaaggtttgcgggcgttgcgcccggaagcgcggttccttgaactggttcatcgtcttgaccgggacacctcaggtgttttgctggtagcgaaaaaacgctcggcgttgcgttctctgcatgagcaattacgtgaaaaagggatgcaaaaagattacctggcgctggtgcgcggtcagtggcagtcgcatgtgaagagcgttcaagcaccgttactgaaaaatattctgcaaagcggcgaacgtatcgtgcgtgtgagtcaggaaggcaaaccgtcggaaacacgctttaaagtggaagaacgctatgcatttgccaccctggtgcgttgtagcccggtaacagggcgtactcaccagatccgtgtgcatacacaatatgcgggtcatccgattgcctttgacgatcgctacggtgaccgtgaatttgacaggcagctcactgaagcaggcacgggattaaatcgcctgttcctgcacgctgcagcgttgaagtttactcatccggggaccggtgaggtgatgcgtatcgaagctccgatggatgaaggtttgaagcgttgtttgcaaaagctgcgtaacgcgcgctaatacaagcatataaacctgataatgggcggttggcctgataaggcgtttacgccgcatcaggccgccagcaccgattgccggatgcgacgtaaccacatccggcgcaaaaaactatcccatcagcgggtttttcccttcccgacgtaacatctgacacagcgcgattagcggtaaaccaaccagcgtgttaggatcacgcccctctaaacgctcaaacagcgtaatgccaaatccttcactcttaaagctacccgcgcagtgcaggggatgctctttacgcacgtaattatcaatctccgcctcgctcaggtgacggaaatggacgtcaaaaggctccacttctgtttgcagatgcccattcgccgaattaaacaacgccagtccagtatagaaggtgacgatattgccgctggctttgcgtaattgcagacgggcattttcttccgttaacggtttaccggtgatttcgccatcaagaacacatacctggtctgaaccaataattaaatgatccggataacgtgacgccagagattgcgctttttcttgtgccagtcgaagcaccaactgtcgcggtgattcgtcgctgcgtggggtttcgtcgacctctggtgctgcacattcaaaagagatttgcagtttttccagaagagcgcgacgccatggcgaggtggaggctaaaataagtttaggcatatttttttccatcagatatagcgtattgatgatagccattttaaactatgcgcttcgttttgcaggttgatgtttgttatcagcactgaacgaaaataaagcagtaacccgcaatgtgtgcgaattattggcaaaaggcaaccacaggctgcctttttctttgactctatgacgttacaaagttaatatgcgcgccctatgcaaaaggtaaaattacccctgactctcgatccggttcgtacggctcaaaaacgccttgattaccagggtatctatacccctgatcaggttgagcgcgtcgccgaatccgtagtcagtgtggacagtgatgtggaatgctccatgtcgttcgctatcgataaccaacgtctcgcagtgttaaacggcgatgcgaaggtgacggtaacgctcgagtgtcagcgttgcgggaagccgtttactcatcaggtctacacaacgtattgttttagtcctgtgcgttcagacgaacaggctgaagcactgccggaagcgtatgaaccgattgaggttaacgaattcggtgaaatcgatctgcttgcaatggttgaagatgaaatcatcctcgccttgccggtagttccggtgcatgattctgaacactgtgaagtgtccgaagcggacatggtctttggtgaactgcctgaagaagcgcaaaagccaaacccatttgccgtattagccagcttaaagcgtaagtaattggtgctccccgttggatcggggataaaccgtaattgaggagtaaggtccatggccgtacaacagaataaaccaacccgttccaaacgtggcatgcgtcgttcccatgacgcgctgaccgcagtcaccagcctgtctgtagacaaaacttctggtgaaaaacacctgcgtcaccacatcactgccgacggttactaccgcggccgcaaggtcatcgctaagtaatcacgcatctgcgtgatgaagcttagtgaggattttccccaggcaactggggaaagaccaaaccgggcggcgacgataccttgacacgtctaaccctggcgttagatgtcatgggaggggattttggcccttccgtgacagtgcctgcagcattgcaggcactgaattctaattcgcaactcactcttcttttagtcggcaattccgacgccatcacgccattacttgctaaagctgactttgaacaacgttcgcgtctgcagattattcctgcgcagtcagttatcgccagtgatgcccggccttcgcaagctatccgcgccagtcgtgggagttcaatgcgcgtggccctggagctggtgaaagaaggtcgagcgcaagcctgtgtcagtgccggtaataccggggcgctgatggggctggcaaaattattactcaagcccctggaggggattgagcgtccggcgctggtgacggtattaccacatcagcaaaagggcaaaacggtggtccttgacttaggggccaacgtcgattgtgacagcacaatgctggtgcaatttgccattatgggctcagttctggctgaagaggtggtggaaattcccaatcctcgcgtggcgttgctcaatattggtgaagaagaagtaaagggtctcgacagtattcgggatgcctcagcggtgcttaaaacaatcccttctatcaattatatcggctatcttgaagccaatgagttgttaactggcaagacagatgtgctggtttgtgacggctttacaggaaatgtcacattaaagacgatggaaggtgttgtcaggatgttcctttctctgctgaaatctcagggtgaagggaaaaaacggtcgtggtggctactgttattaaagcgttggctacaaaagagcctgacgaggcgattcagtcacctcaaccccgaccagtataacggcgcctgtctgttaggattgcgcggcacggtgataaaaagtcatggtgcagccaatcagcgagcttttgcggtcgcgattgaacaggcagtgcaggcggtgcagcgacaagttcctcagcgaattgccgctcgcctggaatctgtatacccagctggttttgagctgctggacggtggcaaaagcggaactctgcggtagcaggacgctgccagcgaactcgcagtttgcaagtgacggtatataaccgaaaagtgactgagcgtacatgtatacgaagattattggtactggcagctatctgcccgaacaagtgcggacaaacgccgatttggaaaaaatggtggacacctctgacgagtggattgtcactcgtaccggtatccgcgaacgccacattgccgcgccaaacgaaaccgtttcaaccatgggctttgaagcggcgacacgcgcaattgagatggcgggcattgagaaagaccagattggcctgatcgttgtggcaacgacttctgctacgcacgctttcccgagcgcagcttgtcagattcaaagcatgttgggcattaaaggttgcccggcatttgacgttgcagcagcctgcgcaggtttcacctatgcattaagcgtagccgatcaatacgtgaaatctggggcggtgaagtatgctctggtcgtcggttccgatgtactggcgcgcacctgcgatccaaccgatcgtgggactattattatttttggcgatggcgcgggcgctgcggtgctggctgcctctgaagagccgggaatcatttccacccatctgcatgccgacggtagttatggtgaattgctgacgctgccaaacgccgaccgcgtgaatccagagaattcaattcatctgacgatggcgggcaacgaagtcttcaaggttgcggtaacggaactggcgcacatcgttgatgagacgctggcggcgaataatcttgaccgttctcaactggactggctggttccgcatcaggctaacctgcgtattatcagtgcaacggcgaaaaaactcggtatgtctatggataatgtcgtggtgacgctggatcgccacggtaatacctctgcggcctctgtcccgtgcgcgctggatgaagctgtacgcgacgggcgcattaagccggggcagttggttctgcttgaagcctttggcggtggattcacctggggctccgcgctggttcgtttctaggataaggattaaaacatgacgcaatttgcatttgtgttccctggacagggttctcaaaccgttggaatgctggctgatatggcggcgagctatccaattgtcgaagaaacgtttgctgaagcttctgcggcgctgggctacgacctgtgggcgctgacccagcaggggccagctgaagaactgaataaaacctggcaaactcagcctgcgctgttgactgcatctgttgcgctgtatcgcgtatggcagcagcagggcggtaaagcaccggcaatgatggccggtcacagcctgggggaatactccgcgctggtttgcgctggtgtgattgatttcgctgatgcggtgcgtctggttgagatgcgcggcaagttcatgcaagaagccgtaccggaaggcacgggcgctatggcggcaatcatcggtctggatgatgcgtctattgcgaaagcgtgtgaagaagctgcagaaggtcaggtcgtttctccggtaaactttaactctccgggacaggtggttattgccggtcataaagaagcggttgagcgtgctggcgctgcctgtaaagcggcgggcgcaaaacgcgcgctgccgttaccagtgagcgtaccgtctcactgtgcgctgatgaaaccagcagccgacaaactggcagtagaattagcgaaaatcacctttaacgcaccaacagttcctgttgtgaataacgttgatgtgaaatgcgaaaccaatggtgatgccatccgtgacgcactggtacgtcagttgtataacccggttcagtggacgaagtctgttgagtacatggcagcgcaaggcgtagaacatctctatgaagtcggcccgggcaaagtgcttactggcctgacgaaacgcattgtcgacaccctgaccgcctcggcgctgaacgaaccttcagcgatggcagcggcgctcgagctttaaaagaggaaaatcatgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctgaccgcgatttgcacaaaatgctcatgttgcgcgcagtctgcgtggttatgagtaataattagtgcaaaatgatttgcgttattggggggtaaggcctcaaaataacgtaaaatcgtggtaagacctgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagttaccaacaatgcttctttcgttgaagacctgggcgcggattctcttgacaccgttgagctggtaatggctctggaagaagagtttgatactgagattccggacgaagaagctgagaaaatcaccaccgttcaggctgccattgattacatcaacggccaccaggcgtaagtgaacatctccaggcggtcgttcgaccgcctgagttttatctttttgtcccactagaatcattttttccctccctggaggacaaacgtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaagttgtcattttccacccttataaaaggtccgcttgcgggccttttttcttagcttttattccgacttgttccgtagtgaacatgctgccacactaacaattctctgataaggagccggtatgttcttaattaacggtcataagcaggaatcgctggcagtaagcgatcgggcaacgcagtttggtgatggttgttttaccaccgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtgctgaaagtcgtgatcagtcgcggtagtggcgggcgagggtacagcacattgaacagcggaccggcaacgcggattctctccgttacggcttatcctgcacattacgaccgtttgcgtaacgaggggattacgttggcgctaagcccggtgcggctggggcgcaatcctcatcttgcaggtattaaacatctcaatcgtcttgagcaagtattgattcgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcctctctggaagagtcgttgcaggcagatgagatggttatttgtaatgcgttaatgccagtgatgcccgtatgtgcctgtggcgatgtctccttttcgtcagcaacgttatatgaatatttagccccactttgtgagcgcccgaattagtcatgaaaaaagtgttattgataatcttgttattgctggtggtactgggtatcgccgctggtgtgggcgtctggaaggttcgccatcttgccgacagcaaattgcttatcaaagaagagacgatatttaccctgaagccagggaccggacgtctggcgctcggtgaacagctttatgccgataagatcatcaatcgtccacgggtttttcaatggctgctgcgtatcgaaccggatctttctcactttaaagccgggacttaccgctttacaccgcagatgaccgtgcgcgagatgctgaaattgctggaaagcggtaaagaagcacagttccctctgcgactggtagaagggatgcgtctgagcgattacctcaagcaattgcgtgaggccccgtatatcaagcatacgctgagcgatgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaaccagttggtgacgatggcatcaattatcgaaaaagaaaccgccgttgccagtgaacgcgataaggttgcctcagtatttatcaaccgtttacgcattggtatgcgcctgcagaccgacccgaccgtgatttacgggatgggagagcgttataatggcaaactttctcgtgcagacctggaaacgccgacagcgtataacacctataccattaccggtctgccgccaggtgcgatagcgacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaagtatatcgtcattgaggggctggaaggcgcaggcaaaactaccgcgcgtaatgtggtggttgagacgctcgagcaactgggtatccgcgacatggttttcactcgggaacctggcggtacgcaacttgccgaaaagttaagaagcctggtgctggatatcaaatcggtaggcgatgaagtcattaccgataaagccgaagttctgatgttttatgccgcgcgcgttcaactggtagaaacggtcatcaaaccagctctggctaacggcacctgggtgattggcgatcgccacgatctctccactcaggcgtatcagggcggcggacgtggtattgaccaacatatgctggcaacactgcgtgatgctgttctcggggattttcgccccgacttaacgctctatctcgatgttaccccggaagttggcttaaaacgcgcgcgtgcgcgcggcgagctggatcgtattgagcaagaatctttcgatttctttaatcgcacccgcgcccgctatctggaactggcagcacaagataaaagcattcataccattgatgccacccagccgctggaggccgtgatggatgcaatccgcactaccgtgacccactgggtgaaggagttggacgcatgagatggtatccatggttacgacctgatttcgaaaaactggtagccagctatcaggccggaagaggtcaccatgcgctactcattcaggcgttaccgggcatgggcgatgatgctttaatctacgccctgagccgttatttactctgccaacaaccgcagggccacaaaagttgcggtcactgtcgtggatgtcagttgatgcaggctggcacgcatcccgattactacaccctggctcccgaaaaaggaaaaaatacgctgggcgttgatgcggtacgtgaggtcaccgaaaagctgaatgagcacgcacgcttaggtggtgcgaaagtcgtttgggtaaccgatgctgccttactaaccgacgccgcggctaacgcattgctgaaaacgcttgaagagccaccagcagaaacttggtttttcctggctacccgcgagcctgaacgtttactggcaacattacgtagtcgttgtcggttacattaccttgcgccgccgccggaacagtacgccgtgacctggctttcacgcgaagtgacaatgtcacaggatgcattacttgccgcattgcgcttaagcgccggttcgcctggcgcggcactggcgttgtttcagggagataactggcaggctcgtgaaacattgtgtcaggcgttggcatatagcgtgccatcgggcgactggtattcgctgctagcggcccttaatcatgaacaagctccggcgcgtttacactggctggcaacgttgctgatggatgcgctaaaacgccatcatggtgctgcgcaggtgaccaatgttgatgtgccgggcctggtcgccgaactggcaaaccatctttctccctcgcgcctgcaggctatactgggggatgtttgccacattcgtgaacagttaatgtctgttacaggcatcaaccgcgagcttctcatcaccgatcttttactgcgtattgagcattacctgcaaccgggcgttgtgctaccggttcctcatctttaagagagacatcatgtttttagtcgactcacactgccatctcgatggtctggattatgaatctttgcataaggacgtggatgacgttctggcgaaagccgccgcacgcgatgtgaaattttgtctggcagtcgccacaacattaccgggttatttacatatgcgggatctggtaggcgaacgtgacaacgtcgtattttcttgtggcgtgcatccactcaaccagaatgatccctacgatgtagaagatttacgccgtctggcggcagaagagggtgttgtagcgctgggtgaaaccgggctggattattattacacgccggaaactaaagtacgtcagcaagagtccttcatccatcatatccagattggtcgtgaactgaacaagccggttatcgtccatacccgtgacgcccgtgccgatacgctggcaattctgcgcgaagaaaaagtgacggattgcggtggcgtactacactgttttacagaggacagagaaacggcgggtaaattactggatctcggattttacatctccttttccggcattgtgaccttccgtaatgcggagcaactgcgcgatgctgcgcgttatgtccccctggatcggttactggtggaaactgactcaccttaccttgcgccggtaccgcatcgaggaaaagagaatcaacctgcgatggttcgtgacgttgcagaatacatggctgtgttgaaaggtgttgccgttgaagaactggcgcaggtaaccaccgataacttcgcccgtctgtttcacatcgacgcttcccgccttcaatccatccgttgaatgagtttttttaaagctcgtaattaatggctaaaacgagtaaagttcaccgccgaaaattgggcggtgaataaccacgtttgaaatattgtgacatatgttttgtcaaaatgtgcaacttctccaatgatctgaagttgaaacgtgatagccgtcaaacaaattggcactgaattattttactctgtgtaataaataaagggcgcttagatgccctgtacacggcgaggctctccccccttgccacgcgtgagaacgtaaaaaaagcacccatactcaggagcactctcaattatgtttaagaatgcatttgctaacctgcaaaaggtcggtaaatcgctgatgctgccggtatccgtactgcctatcgcaggtattctgctgggcgtcggttccgcgaatttcagctggctgcccgccgttgtatcgcatgttatggcagaagcaggcggttccgtctttgcaaacatgccactgatttttgcgatcggtgtcgccctcggctttaccaataacgatggcgtatccgcgctggccgcagttgttgcctatggcatcatggttaaaaccatggccgtggttgcgccactggtactgcatttacctgctgaagaaatcgcctctaaacacctggcggatactggcgtactcggagggattatctccggtgcgatcgcagcgtacatgtttaaccgtttctaccgtattaagctgcctgagtatcttggcttctttgccggtaaacgctttgtgccgatcatttctggcctggctgccatctttactggcgttgtgctgtccttcatttggccgccgattggttctgcaatccagaccttctctcagtgggctgcttaccagaacccggtagttgcgtttggcatttacggtttcatcgaacgttgcctggtaccgtttggtctgcaccacatctggaacgtacctttccagatgcagattggtgaatacaccaacgcagcaggtcaggttttccacggcgacattccgcgttatatggcgggtgacccgactgcgggtaaactgtctggtggcttcctgttcaaaatgtacggtctgccagctgccgcaattgctatctggcactctgctaaaccagaaaaccgcgcgaaagtgggcggtattatgatctccgcggcgctgacctcgttcctgaccggtatcaccgagccgatcgagttctccttcatgttcgttgcgccgatcctgtacatcatccacgcgattctggcaggcctggcattcccaatctgtattcttctggggatgcgtgacggtacgtcgttctcgcacggtctgatcgacttcatcgttctgtctggtaacagcagcaaactgtggctgttcccgatcgtcggtatcggttatgcgattgtttactacaccatcttccgcgtgctgattaaagcactggatctgaaaacgccgggtcgtgaagacgcgactgaagatgcaaaagcgacaggtaccagcgaaatggcaccggctctggttgctgcatttggtggtaaagaaaacattactaacctcgacgcatgtattacccgtctgcgcgtcagcgttgctgatgtgtctaaagtggatcaggccggcctgaagaaactgggcgcagcgggcgtagtggttgctggttctggtgttcaggcgattttcggtactaaatccgataacctgaaaaccgagatggatgagtacatccgtaaccactaatccgtaagacgttggggagactaaggcagccagatggctgccttttttacaggtgttattcagaattgatacgtgccggtaatgctgaaattacgcggtgtgccgtagacgatagaaccttccacgttggtatcgtaggttttgtcgaacaggttattgacgttcccctgtaacgagaagtttttcgtcacctggtagcgggtgaagagatccaccagcgcgtagctaccttgctcggcgcggaaggtgccatacggcgtcacggtgtcggtatacacgcgattttgccagttaacaccaccgccgaccgtcaactctggcatgacaggcaaccgatagctggtgaacattttaaccgtggtgcgtggcagattaggattaacggcgtttccttcgttatcctctgcaatatagcgcgttgcgccaaatgtcagctgccagttgtcggtaattgcgccgttgagttcaaattccacccctttactgactgtcccatccaccgctttataggcggtttcgccgttgctgccggggataggtgtaccggtggactgagcgacattatcctgctcaatacggaagatggctaacgtggtggtcagacggctattcatccagtccgatttcagacccagctcgtagttgttaccggtgattggagccagatatttgcctgaactgtcacgatcattttgcggctggaaaatagaggtatagctggcgtaggtcgaccagttgtcattgatgtcaaacaccagaccagcgtaaggcgtggtgtggtttttctccatgctgtaagtcagcgtatcaacccgccagttggtataacgtgcgccgaggatcagatgcagcggatcggcaagggtgacacgagtggcagcatataacgatttcatatgtgtggtatcgtcctgcgccaggctctgtggtgaccagtcggtttgtgggaaattgccattaaagttgtagaaactgccaatttcatccgggaagatgttggcccatgaactgaagtaacgattgttttgtttgctgtaactgccaccaaacattagattgtgctgacgaccaaacaattcataactaccgtcagcgaacaaatccagcgcatcaactttacgtttgccactgttccaaccggtgccgccgacataatcaaagccaggtccataattactgtatggcccaaccagcataccatccgctttgtttacataggcatcgacatacatcattttgctgtcaaattcgacttcagagtgggtggcattcagtgtcgcttgccaggtatcagcaaactgctgcttcagggtcataaagaccttgttgatctctttatcgttgtacgcccagtcaggtgcggtactgcgtgcgcgatcgtaactgttgctgctgccatcagtattccagcgcggtaaaccgccccaggtagggctattaacatcaatgcgctgatattcgtaaccggctgaaagcgtcgtaagatcgcctaaatcagcatcgacaatgcccgagaagaaggtcttttcactgttgtagcggtccagccatgagtcgttattctggtagccgccgacaattcgcgcgcggattttaccgtcttcggtgagtgggctttgtaaatccgccacataccgttctttgttccagctaccgtattccgccgagacatcgcctttaaattcacgactggtcgcgtgttttcgaaccatattaattgccgcagatggattacccgtcccggtcatgagtcctgtcgcgccacgcactacttctacgcgttcaaagagtgccatatcagaaagtgcgtcgcccagattccagcgcgattcaaaataggtggggataccatcaaccatatagttatcgatctggaatccgcgggaataataaagagcacgatcggaatccgcctgacttttgctgatccccagcgtgttttccatcacttcgcccagcgtttgtaactgctgatcttccatccgctgctggctaacaatagtgaccgactgaggaatatcacgttgagtcatctgcattttggtacccgcagaggtagacgttacgctgtaatcattttcgccatcatctggagctgtggctgaaccctcaacaatcaccgtttcttcagtggctggtgcagcaaaagcggcagaaggtaatagtgccagtgctatgcaaccggcaagtagtgacggtttggtgatggcttgatattgattatccctgttaaattgtgttgaaagcatttgaaatctcttggtttatgttgtcgtcaggctcatgccggaggagggtgatgagcgattatatttagtgtgcgaataattttgtttgtaaatgcaaatgagaaatatacgcattcatatttgtcatgtaaaccaaacagagaatgtcttttcagcgcattcgcaggcagaaatgggaataatggcgatatatacggcagcaaaacgattttttgcttaagaaatcgtgagttaaggttgaaagagcaggtttaactcgaccatactctatactcgcagtgtggcgcggcgtagcatggcgcaacgcatggctatttgaaaaaggaaaatgtcgtggcagaagaaactatattcagcaaaattattcgtcgtgagatcccctccgatatcgtctaccaggatgatctggtaacggcgtttcgcgatatttcgccgcaagcgccaacgcatattctgatcattccgaatatcctcattccgactgtgaacgacgtctcagctgagcatgagcaggcgctgggacgcatgatcaccgtagcggcaaaaattgctgagcaagaaggtattgccgaagatggctatcgtctgatcatgaataccaaccgccatggcggacaagaggtttaccacatccatatgcacttgttgggtggccgtccgctgggaccaatgctggcgcataaaggtctgtaacgatgagaaaaggatgctttgggctggtgtctctggtgttgttactgctggtgggctgtcgttcacatccggaaattccggtgaatgatgagcaatcgctggtgatggagtcatctttattggctgcgggcatcagtgcagaaaagcccttcctttcgacgtctgatattcaaccttcagcatcctcaacgctttataacgaaaggcaagaacccgttaccgttcattatcgtttttactggtatgacgccagagggctggagatgcatcctctggaaaggccacgcagcgttaccattcccgcacattcggcggtaacgctgtacggcagcgccaattttctgggggcgcacaaagtcagactttatctatatttgtaaggggtgaatcttgatgacaaaaatgagtcgctacgccttgattaccgcgctggcgatgtttctcgccgggtgtgtggggcaacgtgaacctgcaccggtagaagaagtgaaaccagcgccggaacaaccagccgagccacaacagcctgtccccacagtgccctcggtgccgacgatcccgcagcagccaggcccaattgagcacgaagatcaaactgcaccgcctgcgccgcatattcgccattatgactggaatggcgcaatgcagccgatggtcagtaagatgcttggggctgacggggtgactgcgggtagcgtcctgctggttgatagcgttaacaaccgtactaacggttcgctgaatgccgcagaagcgaccgaaacgctgcgaaatgcgctggctaataacgggaaatttaccctggtttccgcccagcaactgtcgatggcgaagcaacagttaggtttgtcgccgcaggacagtttaggcacccgtagtaaagccataggcattgcccgcaatgtcggcgctcattacgtgctgtactccagcgcctctggcaacgttaacgctccgaccctacaaatgcagctgatgctggtgcagacgggcgaaattatctggtcaggtaaaggtgccgtttcgcagcaataatcccatcacgcgcgacgaattgctgtcgcgctttttcccgcagtatcatcccgtcacgacgtttaatagtgggcttagtggcgggagttttctcattgaacatcagggccagcgttttgttgtgcgtcagccgcacgatcctgatgcgccgcagtccgcgttcttgcgccagtatcgggctttatcacaactacccgcatgcattgcaccgaagccgcatttatatctccgtgactggatggtagtcgactatctgcccggcgcggtaaaaacgtatttgccggataccaacgaactggcaggcttgctgtattatctacatcaacaaccacgttttggctggcgaataacgctgttgccgttactggaactgtactggcagcaaagcgatccggcgcggcggacagtgggttggctgcgaatgttaaaacgtctgcgcaaagcgcgggaaccacggcctttacgcttaagtccattgcatatggatgtccacgccggaaatttagtgcatagcgcgtcagggttaaaactcatcgactgggagtatgccggagatggtgatatcgcgctggaactggcggcggtgtgggtggaaaatactgaacagcaccggcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacctggcggcagctattaataaaacaataaggagagcagtgtgggtccagtaatgttggatgtcgaaggttacgaactggacgcggaagagcgtgaaatactggcgcatccgctggtgggagggctgattctctttacgcgtaactatcatgatcctgcccagttacgtgaactggtgcgccagatccgcgcagcttcgcgcaatcgtctggtggtggcggttgatcaggaaggtggacgcgtgcagcgttttcgtgaaggttttacccgcttgccagcggcgcaatcattcgctgcgctgtcaggaatggaagagggtggcaaactggcgcaggaggcaggttggttgatggccagcgaaatgatcgctatggatattgatatcagctttgcgcctgtgctggatgtcgggcatatcagcgcggcgattggcgagcgttcttatcatgccgatccacaaaaagccctggcaattgccagccggtttattgatggtatgcatgaagccggaatgaaaacgaccgggaaacacttcccaggacacggtgcagtaacggcagactcacacaaagaaacaccgtgcgatccacgtccacaagcggagattcgcgctaaagatatgtcggtcttcagttccttaatccgcgaaaataaactcgacgccattatgcctgcgcatgtgatctacagtgatgttgatccgcgtccggcgagcggttctccctactggctgaaaaccgttttgcgtcaggaactgggttttgacggcgtgattttctctgacgatttatcgatggaaggtgccgcgattatgggcagttatgccgaacgcgggcaggcttcactggatgcgggttgcgatatgatcctggtctgcaataatcgtaaaggggccgtcagcgtgttagataatctgtcaccgatcaaggcagaacgtgttacacgtttgtatcataaaggttcattttcgcgacaggaactgatggactcggctcgctggaaagcgatcagcacccgtctgaatcagttacatgaacgctggcaggaagagaaagcaggtcactaaccctggcttatgtgaggaagcgatgattatctatttacacggttttgactctaacagtccgggtaaccacgagaaagtcttacaattgcagtttattgacccggatgtacgcttgataagctacagtacgcggcatccgaaacatgatatgcagcatctgcttaaagaagtggacaaaatgttgcaactgaacgttgacgagcgtccgctaatttgcggcgttggcttgggcggatactgggcggaacggattggttttctttgcgacatccgccaggtgatcttcaaccctaatttgttcccttatgagaacatggaaggcaagattgatcgcccggaagagtatgccgatattgccactaagtgtgtgaccaacttccgtgagaagaatcgcgatcgttgcctggtgattttgtcgcgtaatgatgaagcgcttaacagccagcggacatctgaagagttgcatcattattacgagattgtctgggacgaagagcagacgcacaaattcaagaatatctccccgcatttacagcgcattaaagcgttcaaaaccctcgggtaaatgccctcgtcgcatcaggtaaccttgccggtacctgatgcgctccgaattctgtgggtcggataaggcgtccacgccgcatccgacagtcgagcatcaatgcctgatgcgcttcttatcaggcctaccgaacgccctgcatacacccctcactctatatcactctcacaaattcgctcaaataataaacaataaactctgttttttgatctcacccggtaaagtcgcctatcttttcagcaacaaaacttgattaacatcaattttggtatgaccaatgcaccattcatgttattctcaatagcgaagaacattttcattgctgtaacctgttgttaattaagagctatgttaataaccattaattaacaattggttaataaatttaagggggtcacgttgactacgccattgaaaaagattgtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtcattgatattgatcgtgaagcgaaaacaatcactattgcagaactgcgcgacgagaaaggtgaactgctggttccggaacgtaaaatcgcctatgacaccctggtaatggcgctgggtagcacctctaacgatttcaatacgccaggtgtcaaagagaactgcattttcctcgataacccgcaccaggcgcgtcgcttccaccaggagatgctgaatttgttcctgaaatactccgccaacctgggcgcgaatggcaaagtgaacattgcgattgtcggcggcggcgcgacgggtgtagaactctccgctgaattgcacaacgcggtcaagcaactgcacagctacggttacaaaggcctgaccaacgaagccctgaacgtaacgctggtagaagcgggagaacgtattttgcctgcgttaccgccacgtatctctgctgcggcccacaacgagctaacgaaacttggcgttcgcgtgctgacgcaaaccatggtcaccagtgctgatgaaggcggcctgcacactaaagatggcgaatatattgaggctgatctgatggtatgggcagccgggatcaaagcgccagacttcctgaaagatatcggtggtcttgaaactaaccgtatcaaccagctggtggtggaaccgacgctgcaaaccacccgcgatccagacatttacgctattggcgactgcgcgtcatgcccgcgtccggaagggggctttgttccgccgcgtgctcaggctgcacaccagatggcgacttgcgcaatgaacaacattctggcgcagatgaacggtaagccgctgaaaaattatcagtataaagatcatggttcgctggtatcgctgtcgaacttctccaccgtcggtagcctgatgggtaacctgacgcgcggctcaatgatgattgaaggacgaattgcgcgctttgtatatatctcgctataccgaatgcatcagattgcgctgcatggttactttaaaaccggattaatgatgctggtggggagtattaaccgcgttatccgtccgcgtttgaagttgcattaatcgacgtacactggcggatgtggcataaacgcctcatccgcccttgaggaacagcgcgatcggcagccgcgttgtatcaggcatcctttcagactcctccgaatccttaagtatttccagccattcccgcgcttttcatcttctgtctgatagctgcttttctccttcgcttgcatgattggcataactgcaaagaaggaggtgttcccgtgaataaatcaatgttggcgggtatcgggattggtgtcgcagctgcgctgggcgtagcggcagtggccagtctgaacgtgtttgaacggggcccgcaatacgctcaggttgtttctgcaaccccaatcaaggaaacggttaaaacaccgcgtcaggagtgtcgcaacgtcacagtgacccatcgtcgaccggtgcaggatgaaaatcgcattaccgggtcggtgctcggcgctgttgctggcggcgtgatagggcatcagtttggtggtggtcgcggtaaagatgtcgccactgttgtgggggcgctgggtggtggatatgccggtaaccagatccagggctctctccaggaaagcgatacttacacgactacgcaacagcgttgtaaaacggtgtatgacaagtcagaaaaaatgctcggttatgatgtgacctataagattggcgatcagcagggcaaaatccgcatggaccgcgatccgggtacgcagatcccgctagatagcaacgggcaactgattttgaataacaaagtataacaaggctgtactctgcaatttggcccctcattcgctcaggctgaggggctttttttgcgacttatttcaccagttcgggccataaacgcaaagtcgttccggcaatctgcatcagtttttccagcgatgcaccttcgcgtgcgctgatcgacatcccctgaataatacaattaaggaattctgccagatgtgtcacgtcacagtggggcgggatttccccgcgcgcttgtcgttgacataaaaactgctgcaaagtgcgctcttgcatcgcatggcgtgatttcaacgtattggcgatatctcctgaatctggggagagggtggtgcagttgttgatcatgaagcagcctgccggggtgtctttgctggtaaagcagttggcgatggcagcaaaatagtcagccagcgcagactccacgcttttctcttcacaaaacagctgtgcttcatgcttagcggcaaaacgatcgatatagcggtcgagaacggcacgaaataacccctctttgttggtaaattccgcgtatagcgtgggcgctttggctccggtcgcttcgacgaggtccgcaagagaagtcgcttcataaccgtgttgccagaacaatttcatggccttatcaagcgcggcatccctgtcgaacacttttgggcggccacggcttttttttacacattgtgttgagtcagttgccatgatgccgttgtacctggtgactgtgaatgaaaggttattataaaaataatcacctccgttcaccagtccagatcccataaaaataattgctttctatttaactgaaatttaaagatttttaaattaattaatgattgttataaaaaatatcttgtatgtgatccagatcacatctatcatttagttatcgatcgttaagtaattgcttgcgacgtcattcatctgcataaggccactattatgaaaaacgtaaaaaccctcatcgctgcggcgattttaagctccatgtcatttgccagctttgcggctgtcgaagttcagtcaacgccagaaggccaacaaaaagtcggtacaatcagtgctaacgcggggacaaatctgggatcgctggaagagcagctggcgcaaaaagcggatgagatgggcgcaaaatctttccgtattacttctgtaaccggtccgaataccctccatggaacagcagtaatttataaataagcattaaccctcattaatgcctgctactgctgattttttccccgcgacatgccgtgtcgcggggatttttttatccgggctttacagcgtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctctgacagcggctgatgtacttcaaccagacgcgcaccgtttggttcggcagagacttttatcggagtgttgatgatattcactttggtgcctggggtgacctggctaaagagtgttttgatatcgtcatcccgcagacgaatacagccagaacttacccgcatgccaatgccgaaatcggcgttcgtaccatgaagcaaataaacgccgccataggccgccagacgaatcgcatgatggcccattgggttatccagtccagccggcactaccgcaggcaactcaattccctgtgctttataacgggcgcggatgtttgccgttggcgtccaggttgggtttgcacgtttgtctgaaacggtggtcaccattgtcggtgtcagcgtgtcaccacctaactgaccaatacctattggatacacggttaccgaatttttacccggcgggtagtaatagagacgcagctccgcaatgttgatcacaatgccttcgcgcggcgcatctggaagtagggtttgcaacgggatcgttaacacgctgcccgcgcgcggtacgtaaggatcaacgccggggttagcctgtaacagagcgagaaagccgacgttgtattttttggcgatggcttccagagaaccaccgtcattttccaccacatgaaatttgttttcgccaaccagacgactgcccgctggcggcagcggccaggtgttggcttttgccggtagcgccagcgccacggcagcggcgaacgtaaaaaacgttagccagcgagaaaaacgcgttttgatcatcaccaaaaatccataataaatataaggttattgtaataaacagataagcctgaattatggatggtgacagtgtcggatagtgcagggaagtgcaaagaatttgtaaatgttgcagatgggggcgcagaaacgcccccgatttaccattaagcgatcgcgttctcttccagttcacgcataaactggcgtacccattcgatacgcgttttccgctcactcaaatcctgaataaatttcaggcgcgtcggaccatcaaggcggtaatgctgcggctgtttttgcagcaaaccaatcaaccaggccggattaacgtgattcttctcggcaaattcgatcaccccgcctttctcattaccttccagcttcctgatccccagtttctgcgcttgctggcgcagacgggcaatatccagcagggtacgcgccggatctggcagcaggccgaagcgatcgataagctcgactttgatctcttccagttcgttttccgttttggcgctggcaatacgtttgtagaacgacagacgcgtgttcacgtcagggatgaaatcatctggcaatagcgacggcatccgcagctcgacttctgtttgctggctggtgagatcttccagcgacggctcgcgtccggctttcagtgcatcgacggcgttttccagcaactccatatacagcgagaaaccgatggtttccattgagccgctttgttcttcgccaagcagttcacccgcgccgcgaatctccagatcgtgcgttgccagcgcaaaacctgccccgagatcttccagcgaggcaattgcttcaagacgtttttgtgcatcggtagtcatcgcttttggatgcggtgtcagcaaccatgcatatgcctgatgatgcgaacgtccgacgcgaccgcgtaactggtgcagctgcgccagaccgaagtgatccgcgcgttcaatgataatagtgttggctgtcgggatgtcgatcccggtttcgataatggttgtacaaaccagcacgttgaaacgttgatgatggaaatcattcatcacccgttccagttcgcgctcgcgcatctgcccgtgaccgatggcgatccgcgcttctggcaccagttctgccagccgttcggcggctttctgaatgttttccacatcattgtagagataataaacctgtcctccgcgcaaaatttcacgcaggatcgcctcccggaccaccatgctgtcatactcacggacaaaggttttaactgccagacgacgggcgggcggcgtggcgataatcgacaggtcacgcattccgctcattgccatattcagcgtacgtgggatcggcgttgcagtaagcgtcagaatatccacgttcgcgcgcatcgctttaatgcgctctttatgacgcaccccgaagcggtgttcttcatcgacaatcagcaggcctaaatctttaaacttgacgtcactttgcagcagtttgtgcgtaccgatcagaatatcgattttcccttccgccacttccgcaaggatttgcgtctgctctttggcgctgcggaaacgggagatcatttcgatacgtaccggccagttggcgaaacggtcgcggaagttgtcgtaatgctgctgcgcgagaagggtggtaggcaccagcaccgccacctgcttgtggttatctactgccaggaaagctgcgcgcatcgccacttctgttttaccaaagccaacatcgccgcacaccagacgatccattgccagcggctgacacatgtcgctaagtaccgcattaatggcctgcgcctgatccggcgtggtttcaaacgggaagctgtcgcagaacaactgatactgctcacgatcgtgtttaaacgcgaagccctctttggcggcgcgttgcgcgtagatatccagcaattccgccgccacatcacgcactttttccgccgctttctgccgcgcgcgtgaccacgcatcgccgccaagtttatgcagcggggcgttttcttccgcgccacctgcgtaacggctaatcagatgcagtgacgacaccggaacatacagtttggcgtcgttggcataggtgagcatcagatactcgccagtaatgccacccgcttccagcgtggtcattccggcataacgaccgacgccgtgctccagatggaccaccggctgaccaatatgcagttccgcaaggttacggatcagtgtatcggggttgatggtgcggcgagaatcctgacgacgacgggcaacgcgttcaccgagcagatcgctttcgcaaatcagcgccagattacgcaccgtatcgacaaaaccatgttcggcagcgccaatcatcagataacgcccacggtcgctggcttcatcaagacgcataatgcgttgcggagcaattttaattcgtgcgagcagttcacccagcgcttcacggcgaccttcactttctaccgagaacaccaccggaccgtcgaaagtctcgaggaacttacgcagcgcatccagcggcgctttttgttgtgcctgaacggccaggtctggcagtttctggaaacctaaattggcattcgcggcttttgtcggtaaatgttcagtttttagctgcacccggggccagtttttcagctctgagaagagctcgtccacccgcagccagagcgattgtggtggcaacagcgggcgcatcggatcgacgccgcgattctcaaaacgcgccagcgtgtcagcctggaaacgttcggcactggtttccagatcgccagtattcacgagcaaggtattggcagggaaataactgaacagcggcggcagtggttcgctgaagaacaatggctgccagtactcgatcccggcaggtaatgtgcctttactcacttgctggtaaatatgttctggatcgcgcttcacttcgaaggtatcgcgccactggctgcggaacagttcaattgccgctttatcggtcggaaattcgtgcgcgggcagcagattgatcgcttctacttcctccagcgtgcgctggctgtcgacgtcaaacacccgcaggctgtcgatttcatcatcaaagaaatcaagacgataaggcagctcactccccatcgggaagagatccagcaacgcgccgcgcgtggcgtattcgccgtgctccatcacctggtcaacatggcgataaccggcgctgtccagttgggttcgtaatgcatctcgtgacaggcgctgaccttttttcatcaccagcgcatgaccgtggagaaaactgtgtgggcaaacgcgctgcataagcgtattcaccggaacaatcagtacgccacgctgcatcgtcggtagctggtaaagggtggaaaggcgcgaggagataatgtcctgatgaggcgaaaaactgtcgtagggaagagtttcccagtccgccagattcatcaccatttgatcggtaaactggctgatttcatcatgcaaacgcagagcattttgcatatctggtgcaatgagtaccaccggaccggcgtgacgttcggcaatttccgctaccagcgttgcacaggctgcgccggttaactcgcccagcagacgctgctcacccgctttgacgggcagcgtataacgatattgttcaggcataacggttgtcagattctcgttaggatatgcctcaacatatgggggcatatctctgataagcaatgctgttcattatccgtaatcgacatggtttagcaaattgaatcgccccggctggggcgatggcttagcgggagtaactgacggcagcgggcagtgaaggcggggagaacaacagatcgctgaatgcacgctgtgaaagttttcttaccagcaagcccgcaacagtacagatgaacaaactgacaaagggataaaccagcaggagtgtcagttcgacttgcggcgaccagcgtgctgcgttcatttgcgcaagcagagttaagctgaatatttcaaccagaatgcgatgggtggtgtagatagcaatggtgttggagccaatcacattcagcaggctggtggagcgcataccgaatcgttgctcgtattgataaaacagcttcatgatcaccacaatcgataccagcgacaacagcagcgagatagtaaacaaccaggcaccgaccgccagaacggtaagcaaagaagccatcagcagatggcggcgcaacggcacctctttaacacaggtcattattgttgcgccaaaccatgcgccaaggctgtaataaggcaaattgcggatcacactgttcattccccaccacggcgtgggaacgaaattaaccgccacactcagcagtacaaacaaggcgaatagtggcagcgccagacggctaaaaattttacataccacgaaatagacaattaacgcatacagataccacaagctggtgctggcggtgatcatcccgtgcaggaactcaccggtggaatcggcataagcggcattggaggcattgcttaaatcgcgctcaggtgccagccactggttcagcgcacttaacgccagccactgcaccacgccccaaagcgccagcacccagaagatgttccagatccgtttatcgagacaatttccccacggtacgctgtcgatatagcggcgaatcaaatagccggatataaagaaaaaaaccggcatacgaaagggggcaaggtaaagattgaaatagatccagcatttgctcaggacttccgataacggatgctgaaaagtggtcagatgcggataaaaggtaatgaccgagtgataaatcaccaccagacaaatacataaccctttgatctggttaatccatagctctttttgtttcatcaggacaacacgctcttttttaatttacatgcggttgatcctgcgggttatgacccgaggtgtaatgggtatctgtctgtattggatgatttttcagattaagatcaggcggcaagattgatgataaaacatggcaatttagccgattgatttacgggggcttttcagattagccctgacgatcacttacagttcagacgtttacccatcttgctttcgcttatatactcgtgtctttgctacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccagaaacggcagtcaaactggacggcgttaatcgcgtcgcacctattactaccggtgatgtggtactgcaaagcgcgcgcagcgtggcggtcggggtgatgctcggtatcgacccggcgcaaaaagatccacttacaccgtatctggtcaatgtgaaacaaactgacctcgagccggggaaatataatgtcatcctcggcgaacaacttgcctcacagctaggcgttaatcgcggtgatcaaatccgcgtgatggtaccatctgccagccagttcacgccgatggggcgtattccaagccagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgatcgtaaaggcgagttgttccaggccgtacgcatggaaaaaaatatgatgggtttactgctgagcctgattgtcgccgttgcggcgtttaacattattacctcactagggctgatggtaatggagaagcagggcgaagtagcgatcctgcaaacgcaaggcttaactccgcgacaaatcatgatggtctttatggtgcaaggggccagcgccgggattatcggtgcgatcctcggagcggcgcttggcgccctgcttgccagccagttaaataatctgatgccgataatcggcgtcctgcttgatggcgcggcgctgccggtggctatcgaacctttacaggtcattgttattgcgctggtggcgatggctatcgcgctgctgtctacgctttacccttcatggcgcgctgccgccactcaacccgctgaggctttacgttatgaataagatcctgttgcaatgcgacaacctgtgcaaacgctatcaggaaggcagtgtgcaaaccgatgtgctgcacaatgtcagtttcagcgtcggcgaaggtgaaatgatggcgatcgtcggtagctctggttccggtaaaagtaccttgctgcacctgctgggcgggctggatacgccaacctccggcgatgtgatttttaatggtcagccaatgagcaaactgtcgtcggcagcgaaagctgaactgcgcaaccagaagctgggctttatttatcagtttcaccacctgctgccggattttaccgccctggaaaacgtggctatgccgctgctgattggcaagaaaaagcccgctgaaatcaacagccgtgcacttgagatgttaaaagcggtggggctggatcatcgtgcgaatcaccgcccatctgaactttctggcggcgaacgccagcgtgtggcgattgcccgtgcgctggtgaataacccgcgcctggtactggcggatgaacctaccggtaacctcgatgcgcgtaacgccgacagcatcttccagttgcttggggaattgaatcgcttgcagggcaccgccttcctggtggttactcacgacctgcaactggcgaaacgtatgagccgccagttagaaatgcgtgatggtcgtctgacggcggaactgagcctgatgggggcggagtaatggcgatgcctttatcgttattaattggcctgcgttttagtcgcggacggcggcgcggcggcatggtgtcgctgatctccgttatttctaccattggcattgccctcggcgtggcggtattgatcgtcggcttaagcgcgatgaacggctttgaacgcgaactgaacaaccgtattctggcggtggtgccgcatggtgaaatcgaggcggtggatcagccgtggactaactggcaggaagcactggatcacgtgcaaaaagtgccgggtattgccgctgccgcgccgtatatcaatttcaccgggctggtggaaagtggcgcgaatcttcgcgcaatccaggtgaagggcgttaacccgcaacaggaacagcgtctgagcgcattaccctcgtttgtccagggcgatgcgtggcgcaattttaaagcgggcgaacagcaaattatcatcggcaaaggcgtggcggatgcgctgaaagtgaagcagggggattgggtgtcgattatgatccccaactcgaatcccgagcataaactgatgcagccaaaacgtgtgcgtttgcacgttgccggtattttgcagttgagtggtcaactcgatcacagttttgccatgatcccgctggcggatgcccaacaatatcttgatatgggttccagcgtgtcaggtattgcccttaaaatgacggatgttttcaacgccaataagctggtacgcgatgcgggtgaagtgaccaacagctatgtttatattaaaagctggattggtacttacggctatatgtatcgcgatatccaaatgatccgcgccattatgtatctggcgatggtactggtgattggcgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagtggtttcactgcaacttaccccgattattgagtggattgaaaagttgatcggtcatcagttcctctccagcgatatctattttattgatttcctgccatcggaattgcactggctggacgtcttctacgtactggtcacagcattgttgctgagtcttttggcaagttggtatccggcgcggcgcgccagtaatattgaccctgcgcgagtccttagcggccagtaaaggcagtacattaaaacaaggagcggcaatgtattacgggtttgatattggtggaacaaaaattgcgcttggcgtgtttgatagcggtcggcagttgcagtgggaaaagcgggtgccgacaccgcgtgacagctatgacgcatttttagatgcagtgtgtgagctggtagctgaagctgaccaacgttttggctgtaaaggttctgtcggcatcggtattccgggaatgccggaaacagaagatggtacgctgtatgccgccaatgtccccgctgccagcggtaaaccgctgcgtgccgacctgagcgcacgtcttgatcgcgatgtacgccttgataacgatgccaactgttttgccctttcagaagcctgggatgatgaatttactcaatatccactggtgatggggttgattctcggcaccggtgttggcggcgggctgattttcaacggcaaaccgattaccggtaaaagctacattaccggcgagtttggccatatgcgtctgccggttgatgcgttaaccatgatggggttggatttcccgttacgccgctgcggctgtggtcagcatggctgcattgaaaattatctgtctggtcgcggttttgcgtggctgtatcaacactattatcatcaaccgttgcaggctcccgaaattattgcgctttatgatcaaggcgatgagcaggcaagggcgcacgttgagcgttatctggatttattagcggtttgtctgggaaatatcctgaccatcgttgaccctgacctggtcgtcattggtggtggcttatcgaatttcccggcaatcacaacgcaactggcggacaggctgcctcgtcatctcttacctgtagctcgtgttccgcgcattgaacgcgcgcgccacggtgatgcgggaggaatgcgtggtgcggccttcctacatctaaccgattaaacaacagaggttgctatgctgtcgcgtcggggtcatcggttaagtcgttttcgtaaaaataaacgccgcctgcgcgagcgtttgcgtcagcgtatttttttcagagataaagtggtgccggaagcaatggaaaaaccaagagtactcgtactgacaggggcaggaatttctgcggaatcaggtattcgtacctttcgcgccgcagatggcctgtgggaagaacatcgggttgaagatgtggcaacgccggaaggtttcgatcgcgatcctgaactggtgcaagcgttttataacgcccgtcgtcgacagctgcagcagccagaaattcagcctaacgccgcgcatcttgcgctggctaaactgcaagacgccctcggcgatcgctttttgctggtgacgcagaatatcgacaacctgcatgaacgcgcaggtaataccaatgtgattcatatgcatggggaactgctgaaagtgcgttgttcacaaagtggtcaggttctcgactggacaggagacgttaccccagaagataaatgccattgttgccagtttccggcacccttgcgcccgcacgtagtgtggtttggcgaaatgccactcggcatggatgaaatttatatggcgttgtcgatggccgatattttcattgccattggcacatccgggcatgtttatccggcggctgggtttgttcacgaagcgaaactgcatggcgcgcacaccgtggaactgaatcttgaaccgagtcaggttggtaatgaatttgccgagaaatattacggcccggcaagccaggtggtgcctgagtttgttgaaaagttgctgaagggattaaaagcgggaagcattgcctgatgcactacgcttatcaggcctgcaaggggacgcaattaattgaatttgcgggttttgtgggccggataaggcgttcgcgccccatccggaataatacacgcgcacttttccggcctcttttatcgtttactcgtcaataacaatgcggcaataaacgtacagacaccaattagccctgcccagagtggcgatattctggtaatcgcaaagctattatcgatatacaaacataaagcctgataacccatattggcaatagtcatcgccactgcaaattttaacgcataaataaaacgagtcgtgtagtaaaagatcctggaaaataagataaacgtcgcagcccaggcgataaaacctaatgtgttggtgctgccggggggagcattttcatgctgttgtcctggatgcggataatacgttagtggcggcgtcgattgttttaatatctgtgcttgtagaacagccaatgcattattgattccctgataccagagatctgcatttaaataagccagcgtgtgattttctatcagaaggccgagatgtttatcgtccagaccactttcaacctggccgttggtgatcataattaaccgtggttcgcgggtagtaaatagtaacagaacacttccttttacatcactcaatgaagatgacgcatgcgccagcatcgctttaccattttgtctgagactggcttcattattaatgtcgggtaaaaccacaataaacggtgcaattcccgtttgttggcgaaaaagctcggctttatgcgcgatctcttcagcatctggtacagtaccggtaacgtccgtaaaaagtgtcttcattattggaattaatggcttgctggctgctgtcagaggcaggagtatcagtaaactgagcagtataatgaattttttcatgggcgggacttccgtttcctgcgtgattttttagaggagggcatacttattaataaaccgacggcgataaaaataacgcccataatgccgataaacccccatttaaaaaaattaacccacgggttatttatctcagccttttcaggatgcccgggagaataataaacattaactttatcgccttcgctgtcttcataaaaatcgctgccgatactcgaattgaaaattagcgtgtaatctggcgtcggtcgaaaggcaacgacgggataccacgaaccatctttacccgtgcgatgagaatgactggagtgccagacggtatcaacaatgacgccttcggtatgaatcgcgtctttgctataggtgaactggttataaaagacaacaacagaaatgaggatcagtaccagaccgataccgaggaatatacgaaagaaaactttactgtcctgactcattagccacatccttgctaactaaaaaacgggcggtaataccaccgcccgcttgctgaattaacgtcctgctttcagcttctgataatactcttcataaatgctgctggctgcgccaacgtcattctgccattcgccatttttaatggtttcagcatccgggtagagtgttttatcgttcgccacttctggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccacaccacgtcaattggcgtacccgcctggcgtgcaacgaaagcagaaccgttccagatcatgccgaggttaacttcgccttccatgtacgggttcgccgggttatcggagttaaaggctgccacgtttggcatcagttttttcagctcgttatatgcagcttcaatctctttcggatcggtggtgttaccggagtagcccagcttacgcagcgccatctggaacacttcacgggcatcgtcggtcaacagcaggctgcctttgtactctggcttccacagatcggcccagctggtgacagatttcggatccaccgcatcaccgttaacaccaatcgccgtcgcaccccagatatacggaatggagtagtcgttattcgggtcaaaaggcttgttgagcatgtctggatcgagattgctgaagtttgttaacttcgacttgtcgatcttctggatcatcccttctttacgcattttatcaacgtaataggttgaaggaaccaccagatcataggcaccgtctttgtatgttttcagcttggcgtacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaataaccatcaccagcgacagcaccagtaatatggttgccagcgcgttaacttccggcgatacgccgactttgaccatcgaataaatttttaacggcagaatttcataacttggtccggtgacgaacgaagaaactaccacatcgtccatcgacagggtaaagcttaacacccagcccgccgccaccgctggcattgccagtggcagaatgatttttcgcagaatggtaaattcgctggcaccgagatctttcgccgcttccagcattcgcacgtcaaaacctttcaggcgcgaatacaccgtcaccaccacaaatggcaggcagaaggtgatatgcgagaacagcagcgaccagaagccaagctgaatacccagcagcataaacagcaccagcagcgaaatcgccatcacgatatctggtgacatcatcaccacaaacagcattccgctaacgaacggcttaccacgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaagccctgccagttgatgccaaagcgcgagctgttaaaggagttcacaatcaaaataatgattgggatatacaggtacgcgtagatagcggtcataaaaccgccgcgaagcagtcgaccgatcattcgagttccaccttcttattcagcaaacgagaagcgcgccagtaaaccagcaacatcaggcccattacgatagtcagcgtaatgctggtagctgcaccaaacggccagtcacgaatattaaggaactggaccttgatgacgttaccgatcagcaggtttttcgcaccgcccatcaggtcggatacatagaacaggcccatcgctggcagcatcaccagcagacatccggcaataattcccggcatcgtcagtggaataatgatacggataaaagtctgtaacttgctggcaccgagatcgcgcgccgcctcaagcaacggcttatccagtttttcgatactggagtacagcggcatcaccataaacggcagcagaatgtaaaccagaccgataatcaccgcactgggcgtgaacatgatacggattggtgtgtcgataacgcccagccagagcaaaaactcgttgagatagcctttggtgctgaggaaaattttcagcccgtagatacgaattaatgagttggtccagaacggaacaatcagcagaaacagcagcagcggacgcaccttgtgtggcaacttcgccagaaaccaggcaaacgggtagcccagcaccaggcaggcgagggtggcgatcagcgccatattcagcgagtgcaatagcacttcaaaatagagcggatcgagcagacgcgtgtagttatccagcgtaaagaccattttgacaaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcaggatcgtcttcattgaagaattcgctgaccatcaccatcttgccattttccagttcaacaaccgactccagcgtcatgcctttgtagttacgctcgcgaacgtaaccaatcagcccttcagcgtggttgtcgtcgttaatctcttcaacacgtaagtcttccgggcgcagcagaacatgcagtttttgccccggttcaacggcgaagttaacgtagatattacattcgcggccttcaacgttggcgcgtacgcgctgctcgtctagacgttcgatgacagtggcgttaaacatattgatttcgccaatgaagccggcaacaaacaggtttttcggctcttcgtagatttcacgcggcgtgccgtcttgctcaatgcgaccatcgcgcatcaccacaatcctgtctgacatggtgagtgcttcttcctggtcgtgagtcacaaagacgaatgtaatgccaagcttacgctgtaacgctttcagctcgttctgcatttgcttacgcagtttgtaatccagcgctgagagcgactcatccagcaacaacagacgaggcttgttaaccaccgcgcgagcaatggcgacgcgttgctgttgaccaccagagagctgatgcggtttgcgttgagcgaaggtttccaactgcaccatccgcagggcttccatcacgcggggcgtaatttcagcagcgggggttttttgcatgcgcaacccaaaggccacattttcgaacacggtcatgtgggggaaaagtgcgtagctttggaaaacagtgttcacatagcggttttccgccggaacgtgggtgatgtcctcgttatccagcatgatgcgtccggaatcaacagtttccagacctgcaatcaggcgaagaacggttgttttaccgcagccagaagggccaagcagcgtgaggaactcgccattgttgatagtcagatccagctggggaatgacctctttaccatcaaagcatttgcgaattcccgccaattgcaccagcggtgaaagcgaactcggttgtttattcaattttttactctgtcccatgtaaacgcaacggatggcttaccgatgcggggtttgtggttaaccaccttggtgactcttaatgagggcggtaattctacggcaaaccgcttgaatcgccaatctttgttgtgaattactggcttagctttatattcattaaggtaatgctgataaatattcccgcttgcaggggtaaaagtgacctgacgcaatatttgtcttttcttgcttcttaataatgttgtcacaaaaagtgagggtgactacatggataaactacttgagcgatttttgaactacgtgtctctggatacccaatcaaaagcaggggtgagacaggttcccagcacggaaggccaatggaagttattgcatctgctgaaagagcagctcgaagagatggggcttatcaatgtgaccttaagtgagaagggcactttgatggcgacgttaccggctaacgtccctggcgatatcccggcgattggctttatttctcatgtggatacctcaccggattgcagcggcaaaaatgtgaatccgcaaattgttgaaaactatcgcggtggcgatattgcgctgggtatcggcgatgaagttttatcaccggttatgttcccggtgctgcatcagctactgggtcagacgctgattaccaccgatggtaaaaccttgttaggtgccgatgacaaagcaggtattgcagaaatcatgaccgcgctggcggtattgcaacagaaaaaaattccgcatggtgatattcgcgtcgcctttaccccggatgaagaagtgggcaaaggggcgaaacattttgatgttgacgccttcgatgcccgctgggcttacactgttgatggtggtggcgtaggcgaactggagtttgaaaacttcaacgccgcgtcggtcaatatcaaaattgtcggtaacaatgttcatccgggcacggcgaaaggagtgatggtaaatgcgctgtcgctggcggcacgtattcatgcggaagttccggcggatgaaagcccggaaatgacagaaggctatgaaggtttctatcatctggcgagcatgaaaggcaccgttgaacgggccgatatgcactacatcatccgtgatttcgaccgtaaacagtttgaagcgcgtaaacgtaaaatgatggagatcgccaaaaaagtgggcaaagggttacatcctgattgctacattgaactggtgattgaagacagttactacaatatgcgcgagaaagtggttgagcatccgcatattctcgatatcgcccagcaggcgatgcgcgattgcgatattgaaccggaactgaaaccgatccgcggtggtaccgacggcgcgcagttgtcgtttatgggattaccgtgcccgaacctgttcactggcggttacaactatcatggtaagcatgagtttgtgactctggaaggtatggaaaaagcggtgcaggtgatcgtccgtattgccgagttaacggcgcaacggaagtaagcgaaaagggatgcggcatgtgatgccgcatccggcttaaatccaaacttacccttcgaagaaccaatacccgctattgaccagcgccgcgagcatcgcgaggaatgacggatcttccagcgcatcgccaaaattctccgcagtcagcgcaatgttgctggcgagtgcatccagtgccggacggtgcggggaatcgatcttctcaccattggcatacacgtcgtcgccaatgcgcaatacgcgcagaccacccaggcgcaccagcacttcaccttgtttcagcgcatcgtagatttcatccggctgataaggcggctctggcggcgcgatatccagttcatgacgtgactgggatataaactcgccaaaccattgcttaaagtgttccggctggttgatcaattcgagcatcatctcacgcagtttatccatctcttgcggcagaacatccgcaggatgagcgcgaggtggaacatccggatcgctgtagtagttgccgcccagttcacgttgcagcacataatcggcaaatccactaatcagttcccgcgtatttggcgcgcgaaagcccacggaatagttcatcgcattttccagcgcgtagccttcatgcgggaatcctggcggaatataaagaatatcaccaggctccagctcttcatcgatgatggcttcgaacggatcgacctgtaacagatccggatgtgggcagtgctgtttcatttgcagcttttcgcccactcgccagcgacgacgtccggtaccctgaatgataaacacgtcgtactgatcgagatgcgggccgacgccgccgccgggtacagaaaaagaaatcatcagatcatcaatacgccagtccggtagttcacggaacggtcgcatcagcgcggcggtcggctcatgccagtggttcactgcctgtaccagtaatgaccagttggtttcaccgagatgatcgtagctttcgaacgggccgtggctgacctgccatttgccatcctggtgactgaccagtcgactgtcaacttcgctttccatcgccagacccgccaactcgtctggagagatcgggtcaataaaattattaaagccgcgttttaacaccaccgggcgtttctgccagtgacgttcaagaaaatcgggccagttaagagtgagttggtattccatgttaagcatccacaggctggtatctgcaaccgattataacggatgcttaacgtaatgcgtgaagtatgggcatatttattcatctttcggcgcagaatgctggcgaccaaaaatcacctccatccgcgcaccgcccagcatgctctctccggcgacgattttaccctcatattgctcggtgatttcgcgggctaccgccagccctacaccttgcccagggcgtaaagtatcaacccgttgaccacggtcgaaaatgacctctcgcttgcttaatggaataccggggccatcatcctcgaccacaatatagagatgctcgtcggtttgccttgcagaaatttcgacaaactcgaggcaatatttacaggcattatccagcacgttgcccatcacctcgacaaaatcgttctgctcaccgacaaagctgatctctggcgaaatatcgagagagatattgacccctttgcgttgatacactttgttcagcgctgaggtgagattgtccagcagtggggcgaccggatgcagctcgcggctgagcaatgtcccgccgcgcatactggcacgatgcaggtagtagccaatttgctgtgaaatgcggctgatttgctccagcattaccggctcagcatcactgacgctcatcttttcactacgcagagaacgcagcgtactttgcagcaccgccagtggcgttttcagactatgggtcaggtcggtgagcgtcgtacggtatttgtcgtaacgttcgcgttcactttttaacaatcggttcaggtttcgtaccagactggtcagttctcgcgttgtggctggattgagcaattcgcggttatgttcttccagttcgcggacttcttttgccagggcttcgatggggcgtaaactccaccaggcggcgacccacagcagcgggatcactaacagcagattggctgagagcacatagataaaccagctccagaccatataggaactttttagctccaccggaatggtatccaccaccacaatggttaattttggcatccgcgatgttgccgggtagacgtttactgccaccgagtgggtcatctccgcgtcgtcatcatcttcccgcacttcctgcaactgttgctgtatcgaatgatctccactcagcaagaggctggtatcgttaacatccgcttcaatttcatgaaaaccattcgatttcagccagtcaggctggatcatcttcatcagccagggcacgtcacgttgcgcccataaaagctgcccgttctcatcataaattagcgtcatggtggggctttgcttgtcgatattttcgggtaactcgacatgcaacttattgttttcccacttcgcaagggtatagaacagattgctctcgccacgtaacagccgaaacgtagttttatcgaaactgacgctataaccgatcagcgcgaccattccgtaggcaagcgaaagcaccagtactaccgctgccgttgccaacagaaaacgtacccgcagcgagagcgggaaaaaaagacgcagtaattttttcatcagcgcaattcgaacagatagccctggccgcgaacggtggtaatcacttcttggggatattgtgcctgaatttttttgcgcagacgtcccatcagtacatcaatggtatggctttcccgcagctccgcatccggatagagttggagcattaacgaatctttgctgaccactttgccattattgcgtatcaacgtttccataatagtgtattcgaacgcggtcagtttgatcacttcgtcattaatagataattcacggcgagagagatcaacctgaaacggggggagcgaaatgacctgtgaagccagaccgctattacgccgcattaatgcctgcattcgcgccatcacctcttcaatatgaaacggtttagtcacataatcatcagcaccggcacttaatacttcgactttgtcctgccagctttcacgggcggttaataccagaatcggcagtgaaacatcgttgctacgccagcggcgaatcagtgacagaccgtcctcgtctggcaatccgagatcgacaatcgcaatatccggtatatgttcattgagataataatcggcttctttggcatcttctgcgtcatcgacctgatgaccagcatcctgaatctgaactttaaggtggtgacgtaacaacgcattgtcttcaacaaccagtacgcgcatttttatttctccctgtcttaattattaaaatagtgtaacgcgattatgtggttatgggggtaaacattaaataaaccagcggggaggggaggtaaagtgaaaaaataaaaagcggataatcttaataagcaggccggacagcatcgccatccggcactgatacgaggtttatttcagctcatcaaccatcgtgatagctcgaccaatatagttagccggcgtcatcgctttcaggcgggctttctcttcttctggcaacgccagaccatcgataaactgcttcatgccttcggcgtcaacgcgcttaccgcgagtcagctctttcagcttctcgtacggtttttcgatgccatagcgacgcataactgtctggattggttcagccagcacttcccagttgtgatccagttcatccagcagatggtcacggttcacttccagtttgctcacgcctttcagggtggattgatatgcaatcaaggcataaccgatacccacgccgaggttacgcagcacggtagagtcggtcaggtcacgctgccagcgggaaaccggcagtttgcttgccagatgctgcaataccgcgttggaaaggcccagattcccttcggagttttcgaagtcgatcgggttaactttatgcggcatggtggaagaaccaatctcaccagcaatggttttctgtttgaagtggttaagggcgatataaccccagacgtcacggtcaaagtcgatcagaatagtgttgaagcgcgcaacgcaatcaaacagttcggcaatgtagtcgtgcggttcgatctgggtggtgtacgggttccactgaatacccagcgaggtgacgaactcttcgctgaactgatgccagtcaacttccgggtaagcggcgatgtgggcgttatagttaccgaccgcgccgttgattttgccgaggatctccacctggttaagctggcggtactggcgctccatacggtaggcgacgtttgccatctctttaccgatggttgacggcgtggctggctgaccgtgggtacgagacagcagcgggatatcgcgatactgaacggcgagatctttaatgccatcaatcagttgacgccagtatggcaggatcacttcatcacgcgcggttttcagcattaatgcgtgggagaggttattgatatcttccgaagtacaggcaaagtggatgaattcagaaaccgcgtgcagttccgggatctccgccactttttctttcaggaaatactcaaccgctttaacgtcgtggttagtggtacgctcgatagttttgatgcgcgccgcatcttcttcgctgaaactggcgacgattgcatcaaggtaaccgattgcgtcggcagcaaaagcaggaacttccttgatcgctgcgtgcgcggccagtttttgcagccaacgtacttcaacttgtacacggaatttcagcaaaccatattcgctgaaaatcccgcgcagcgcgctgactttatcgccgtagcgtccatcgacaggggaaacggcggtcagtgaggataattccatagatcacaactccggggttaaatgagcaagaatttgttttgcctgagtggtcaggcgattacgagaaaacatcagttgcagacgtccgccgccgacctggtgccagagcacggcggcgcgaatgcctgccagcagggttgcgcgaactttcgcctgcacttgtgggctttgcagtacagcaggggaaccggtgacctgaatgcgcgggccaagcgggctaatcacatcaacatagatagcagccatcgcgctcatcagcgtttcggactgtaaatcgaagtgttcgagctggcgttgcaggccgttgatccggttgcccagagtgtcgagcgcgcctttcgctgaggagagtttgcgctcaagcaccatcaagctgagtgtgtagcgggttaattcggcgtttaagccctggcgactgctggcattgagcacgccgagcagggtttccagcccgacgcgcaggttggcttcgctaccgccaaaaaccgccagcgtcgagctggggttcatatcaataatactgttgagtgagacgtgtagcgcatcggcatcacaatgcccctggtgagcgagttgttgcaccaggcgtgccgactgacaaataccggccagggcgagggtgatgtcatagtaattctttgccacgttcactgcttccttgttttaagtaaagataataatcagaccggcagcggcagacgctgctcaataataccgccaccgaggcacacttcaccgttatagaagacggcagactggcccggcgtcacggcggcaaccggttcatcgaaaatcacttcaatgcgatcatcgtccagcgccttgacggtgcaagggatatcggtctggcgatagcgggtttttaccgtgcaacgcatagtgccggtgaatggttcgcgatcgacccagtgcaactgctgggcaatcaacccgacagacatcagccgcgggtgttcatggccctgagcgacaaccagaatgttgttttcgacgtctttgtccaccacataccacggttcttcggtaccttctttggtgccaccgatacccagacctttacgctgaccgagagtgtgatacatcagcccctggtgctcaccaatttcatcgccatcgacggtaatgattttgcccggttgcgccgggagataacggcccaggaactcgcggaatttacgttcgccaatgaagcaaatgccggtagagtcttttttcttcgcggtgaccagaccaagatcttcagcaatcttacgcacctgcggtttttccagttcgccgaccgggaacaggctttgcgcaatctgctcatggctgagcgtataaaggaagtagctctggtctttattgctgtccagaccacgcagcaggcggctcttgccatcgacatcggcccgacgtacgtaatgaccggtagcgatataatcggcacctaaatcttcggcggcaaattcgaggaaggctttaaatttgatctctttgttgcacagaatatccggattcggcgtgcgaccggctttatattcggcaaggaacagttcgaagacgttgtcccagtactcggcagcaaagttaacggtgtgcagttcaatgccgagcttgtcgcagacagcctgggcatcagccagatccgctgccgctgtgcaatattcctcaccgtcgtcttcttcccagttcttcataaacaggccttcgacctgatatccctgttgttgcaacagccaggcagaaacggaggaatcgacaccgccggacatgccgacgattactttttttgcggtttcagacattggatcactcacgacattgaacttcaaggcggcgtattctatcacgcagccttttagatgacaccctttgtaaaaggccagttaaaatcgccaatcatctccagcggataacgttgcccgctttgataacaacgaatactttccgccaccagcggcgaacgaagatttgacgcctgtaaaatttcttcggcgctgacccaacggcagcagtcgatatcgctgtcatgaggctgggtcgggcatatttgctcaagctcaatggcaaagaggaaacgcaaaaacggcgttttatctggcgcaatccactgatgcatacgaataaagtgttgcggctgcgcgctgatgccggtttcttcccacagttcacgggcggcggcttccactaaggtttcatcggcttccagatgcccggcaggttggttccataacgctttaccattaatcgtctcttcaacgactaaaaatttgccttctgcgtgcaccacgcaagcaacggtaacgtgcggtttaaacattttgcatccttaatctgtcacttctcgccattcaccattggcaagattatccaaagagtaatcacccatcgcatagcgaatcagtcgcagcgtggggaagccaacatgggcggtcatgcggcgcacctggcgattacgtccttcatataaggtgatcttcagccagctggtgggaatacttttgcgttcacgaattggtggattccgcggccataaccacgcgggttcgtcaaccagctccgcgccggcgggcagggtagggccatcatttaaggttacgccattgcgcaaggcttcaagtgcgtcttgtgtgggaataccttccacctgcacataatagatttttccggtgcgtttacccggctgggttaaacgcgcctgcaacgcgccgttattggtcagcaccagcaacccttcgctatcgcggtcaaggcgacctgctgcataaacaccctgaaccgggatgaattcttttaatgttttgcgtccggcttcatcggtgaactgcggaagaacatcgtagggtttattgaacaggatcacacgcgtgggctggttttcaggtttacgcctggtagaacgttgcgagctgaatcgcttaacctggtgatttctaaaagaagttttttgcatggtattttcagagattatgaattgccgcattatagcctaataacgcgcatctttcatgacggcaaacaatagggtagtattgacaagccaattacaaatcattaacaaaaaattgctctaaagcatccgtatcgcaggacgcaaacgcatatgcaacgtggtggcagacgagcaaaccagtagcgctcgaaggagaggtgaatggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggacgtctggctgcctgctgaaactcttgatctgattcgtgaatatcgcgttgccattaaaggtccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggggtgaagaaaattcgcttcccggaacattgtggtatcggtattaagccgtgttcggaagaaggcaccaaacgtctggttcgtgcagcgatcgaatacgcaattgctaacgatcgtgactctgtgactctggtgcacaaaggcaacatcatgaagttcaccgaaggagcgtttaaagactggggctaccagctggcgcgtgaagagtttggcggtgaactgatcgacggtggcccgtggctgaaagttaaaaacccgaacactggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatatgccggtcaggacaaagtaaatcctggctctattattctctccgctgagatgatgctgcgccacatgggttggaccgaagcggctgacttaattgttaaaggtatggaaggcgcaatcaacgcgaaaaccgtaacctatgacttcgagcgtctgatggatggcgctaaactgctgaaatgttcagagtttggtgacgcgatcatcgaaaacatgtaatgccgtagtttgttaaatttattaacgggagcgtaacgctcccgttgttttttgttaggctgctaacggttatcaaaattttatcaaaaaaagttatcaaaacccctcggtagttttggggtaggctggccggtcaggtggtagttctactactagtctcccacatagatattccttagctttttattattgctggcggacgctcgttaatatttaaggtcttcattgattaagacatccccaaagttagttatgtattcactgttattaggacaattatgaattaccactccttacacccgctcaaatattgttaaattgccggttttgtatcaactactcacccgggactcgccaggggacagccaacaggcattgggtgcaatcaccttagcgttcaggtacatgcggaatgtaaaaaaggccgcgagcgcggccccttcacatacatctttagtactgagactgtttaacctagggaattattatcgtattatattgcattacaactcccaacagtgacatatgaacttcctgctttactccacgactttaatatttcaaggccatgtgaagaacatatttcttgcactgcgagttcatcgagtaatccatagtaagaaacactttttgaatttttgtaaatgtatccgtaaagatgttttcttcctgtttcgtattttttgaagtatgagcttttatattgatttacaataagagtctcacctcctgattttagtaatctcttgatgctaagaactattttgtcgattgtatcccgacaaggaacggcagagagaacattagagcaaaggatgaaatcgtaacccccaattattttgtcgacatcctcgaaagcaactgtatttgcatttttataatatcgtgggacatagtcaataattttagttttaattcctctaataatttgctctctttcaagttgccttttcgagtctagaaaagtaacttcatcaaatttactgattaattcatcagaatatctaagttttccgcagccaaaatcaagggcgtggccatttttctcaatgcttctaatatactcgcaaagatatctagagggcatcgtatgaggttttgctgcattctctgagcgaatattaactccgtgcatattatagttcaaagcaagtaccattcaattaatgttatttttagtgaaaaattcttttattttatcgtccgggatttttccgacttgactttcagttctgggcttaactgtcaaagcaaagataataccactcactgagaatgataaaattacaaaaaagaataaagacagcaaagaaccttcaacatgaaaaatatccatttgtttgcaaaaaaagattattaggaaggaaattaatgcaattatcgaaaattcaaaaaatatccaaaaatagtatactttattccagaagagttcaatataatgtttgtcttcaatttttcttacttcagggtaatatagattgctcattacattgtgagcttcatctttatttaattttctgttgactccagctctccgtgataacggttttataattagatgcttatcccaaagatatcgcacccgaagtagtttggctgcattgttatgtaggtctaacgcaccgctaattaaatatgcaaaaatcgcaaaagcacaaggtaatataccaaaagatagtgcccaattaataaagctctcatgatctttaataggtgggacatacttggttggtaatgttattaaagggatgtattcgtaaataactagaagtatgcaatatattagcgtatttaagaaagttgctttatgaagtttaggcaacatttcattataatttttggggggttcgaacatattattcacctgagtcacgctttaggatagtgtaatggtaatatttaattaagtgtcattatatacttttcagtaggttagttacaattttttgtatctgttcaggctgacctagcttcgctgacagacaatattgtgatcagtagcacgtatcgaggaggagtagcgctacaaatttgacgctgggtgagaatctgaaattgatagaaatgaaataatgaaataatgaaatgatgaaatgatgaaatgatgaaatgatgaaatgatgaaatgatgacagagtgtccagtgggcacggatggtgtcttacgacatgcttaccttaatcgttcccagtgtgcctatagcagatattctaaacatgtcgataattcattacgcatatagtatcgaacatagaaaaaactgaagattcatcttattttgtatatactacctagcccaacaatgtagaggttaacgaaaaatgcgctcaccaatttgtcatcttttctcagcaattaattcatcaccatttaagattgcaccagagaaggagcaagatcttaaaacgatagttgacgacaaaaaaattataatttcagttgtgagtgaacctggttttaatatccgagtcaggaagaatgagagtaataattcacatgaaatagttctaacagtagcttcacttgaatatatttgggcattttccaatttcttttgggtttttacgcaagagtactccaaatctcagaaaaataatgatgagcactttgatttaacaggaaaaaataggcttaaaaagtctgatgaacttcttaaatgggcaaggaaaaacttgcaaacaacaggttgcgaatcatggcctaaaaaatgtcccaagccagaagcatatttacaaggaagcgaagactcacaagttgctagcgagatatttctttgtgctattgcttggattcttcatcatgaaataagtcatgttgttttacagcatccattggtcactacagcattctccactcaagaggagcgtgaagcagattcacatgctacaaaatggatattaggcaacctgtatgaatccgctcctgaattaaagaaacgtgcacttggcattgctacggcagtgctttgtatacaaagcttagaagttgaaaattacttctgtttacaaaatacacacccagctgcatatgagcgtatatattcgaatatttcatgctaccctgtcggaaatgaagagttgattgaagctctatgtacagtgatgcttcaatatcttttccatggcaaaaatatcaatgtgaatctagatggggagtccttttcatcgattttaggtgatcttctctgtgatatttcacgtcttaccagtaactgatatggctgtccgccgctcgcttaaagtggactttttagtttttatcatgtgcggtgagaaattcaatgtggcgttgagatgcttaaaggttcacaacgctactttgctccatcctttacctcgatcatcatgataacgatcggtttgttgttgtgttttatgaccaagtagtttttgtgtgtctaacccctgttctttatacagacgttcagataaagacctttgctcatggaatgtcgcaggtgaaccctctccccagtcaattcttgctaaatctctcgctttactaaaattcatcgtcaatgtattggctttaacctgcgctccgcgctctgcttgtgaagttgaacgaaaaaaatgcactaagtatgcactgactgcatagtcacggcagcgggctactacatcgcgtaaactccagttaatcgcattgaggcgaagagaaagaggaattgcgattttgctcccggtcttttcctgaatgacatgaagatgatcatcccaaatatcgctaaatttcatacgcgaaatatcacctaaccgctgaccagtaaccagcgctaacagcatggcatttcccatgtaacgatgagtagcgtctgcgatatcgaagatttttttccattcttcaaggctcagccgttgtcgggtaatttttcttcttggttgtttagtggctaatgctgggttatagccaggaggtacttctccgtagtgctgcgcctctttgaaaacatcaatcaggacggagcgaactacttgtgccattcttggccgcccagcggcgatatactcatcaagcaattgtgctatatctctgacatcaacggctgagatcaacttcattcctgctcgttctctgagcaaggatactggtttagctttttgtttataggtgttgagtcttatatcaccacttttaagcctgtcatcctggatcgcttgatagcgatctaaccaggttgacgttgtgatagcctttcctttgctggttgcgatcctgtcactgatagccagaatctgccgggttctttgttcagccaggcgagtgttggcctcagtggcaatagcgatagcttcagcttcgtttgttcccaaagcatggaattttcctgtcactggatgcttataccgccaatagactttatttaccttcctactataaagcggatataagttagggactgaaacattattcttacgcggtctggctgccattactcaaaatccgttgcaaaagtaatgagtcatttttcttgattacaggtgttaccaactccccaactaactcggcgtcctcacgcactcgccataaccggccttgtttcatggccggtggacaaaataaattctgcttagcataacgacgcaatgtggacacacttggaggattacttctgtatttttcagcagcccattcttcaagagttaacatttgaagcatatgcgatcaccttattactacactaactgcttagtctcagcatatcgaccctgcacggtcggttagtttctccacaaaacagagaagagcacctgtggccacagctatcaggatgggtcgggttattaacccgtcatccggggatactcttctctgttttgtaaaaagggcggtaccagaaaggactaaggaaaaaactggtaccgccaagactacacacagcataaagttgtggtgtcgggtgcccccggtgcctggcgaaggttgcacaccaggcgggtgggtatccacagaaggtcgattgtcagcctcaaccttaacccgcgtgcgctgagccgcattcaccacaacgctaaggattctctctggttgaaaatacttagctgttatgtgcctgtcttttcaccacttcaggctcggtggtatgctggagttctcacacagccagcaagcaaggaaacttaatgaaccagttttatgttcacgttcgtctatttgaagacacagccgaacagaccaaaaaatttgaagaattaatgcttaactttctgtaccagaaaacagttaaagagtctgacgatagctgctgcagactgattccagagggatatatcctcaaaagtacaatgaactgccaacaaatccttgatcaaacattttcaattgctaacagtgccggtgttgacgcaaatatatttgtctgtaaatttgaacaaagcgcatgcttacttccgtctgcttccttagttggtaacgatttcgttcattacgatcttacgcctaagcccatcaagctcgattcttaaagccttaaccattgtgtcgtgataaacacggctcaccttctctccattgcatggcagaggggtgagtgtgttagccatgaaattcatgaactcggttcgaccaggggcttgcgccccgcaagtctttaatgcctgttttgctaacaaaatgcgggcctcagtgcctgcatttggctctatctgctgcaaacgtttagcgtcttccagcaacaatgcgatcacatgcttcaaattctgctcattcatctattctctccactgaaatcatccgctaacgaatcatcccggtcttcgtacgtaccgggcgggctacttcgtgggcgtcctgcctgtttgttgtttctcttgggtacattatgtatctcaaaggtacattgtcaagtataaaaaaacctgccgaagcaggttcataaacattgattaggctttgattttgtatcttcttggttttcctgagaaaatcacagtaccaattatagagcaattaccgttgatcttaatgtaaggctcaggccagtttgggtttaacgctttgagataacgctgtgtcccatcttctatcaaccttttgaaggtggtttcacctgtatcgtgcatcaatgcaataacgtcgtcaccgtggcaggcaggtacttcaggatcgacaaaaatcatgtctcccgggcggtactcatcaatcattgaatcacctattacccgcaagatataagtcatttccccacagggtacagggcagggatacgtttctgctgtgctcaaatcaacctcagaatatccaacttctttccatgctccggcctgtacccatgatatgacagggactaatgtgatttgtttattagtgattgaaacatcaggtttttttgtgatgttcgttgtctggtgttcttgatcgagccatcctacaggcaggtcgaaacatttttcgatgtgtcgtgccatgctgtcaccgatatttttagtagcaccatctcccataaacctgctggtctgggttggctcgcgatcaatcatagtggcaaaggaagaattcccgccaacaccatctctcagttttctggcgttagaccgccggatgtcatggattgttttcataacgaaattaaaacccttgtaccgttaaggtacaagtatcttgaaggttcatttcaatcatgtaatatgtacaccggaggtacatattgtatgaaagcgtattgggactctttaaccaaagaacagcagggcgagttggccggaaaagttggctcaacacctggctacttacggctggttttcaatggctataaaaaagccagttttgtgctggctaaaaaacttgagcaatacacatcaggtgcaattacgaaatctgacttaagaccggatatctatccgaaagattagcagaacactttcaatttttaaccacagaacgatgaggctaatcgtgggtaagcatcactggaaaatagaaaaacagcctgagtggtacgtgaaagctgtcagaaaaactatcgcggcgttgccgagtggttacgctgaagcggctgactggctcgatgtaacagaaaacgctttattcaaccgccttcgtgcagatggcgatcagattttcccgctgggatgggcaatggttttacagcgtgctggtggcactcacttcattgctgatgctgtggcgcagtctgcaaatggcgtctttgtgtctcttcctgacgtcgaggatgtggacaacgccgatattaaccagcgtctgctggaagtcattgaacagatcggcagttattcaaaacagattcgttcagcaatcgaagacggtgtagtggaaccgcatgagaagacagcaattaacgacgagctgtatctctcaatttcgaagctgcaggagcatgcagcacttgtctacaaaattttttgcatttcagaaagtaatgacgcccgcgagtgtgcagctccgggcgtcgtggcgtcgattgcttctggttgtggagaaactaacgcatgaacagtttaacaacacactaccgtcgctcgcaactgattgcgcttcctgtaccgggtggaaaagcgaaggtggaatattgctatgcagtgaatgtaccaggtgacagggaaattgtaacccacagctttgcagagtgggctgtgggtgatttcaaccggcagaaggagacagtcctttgcgacaagttaaccgctggttcaaagatcactacggagtgcccgtcagagtcattcgttgggagccggaaacacaacgggttatctacctccgcgaaggttatgagcatgaatgcttcagcccgctcgaacagtttcgtcgtaaattcagggaaatagaggtcggtcatgagcactaaattaaccggctatgtatgggatggttgcgctgcatcaggcatgaagttatccagcgtggcaattatggcccgcctggctgatttcagtaatgacgaaggtgtgtgctggccatcaattgaaaccattgcccgtcagattggcgcggggatgagtaccgtcagaacggctatcgcacggctggaagcagaaggctggttaacgcgtaaggcgcgtcgccagggtgatggttcatcaccccactgtgccgtggtggatgaatatcacgagcacgccacagatgcgctttacaccacgatgcttaccgggatgggggcgcgacgccagccactgatgtgggccattaccaccgccgggtacaacattgaggggccgtgctacgacaaacggcgggaagtcatcgagatgctcaacggctcggtgccaaacgatgaactgttcgggatcatctataccgttgatgaaggtgacgactggaccgacccgcaggtgctggaaaaagccaatccaaatattggcgtgtcggtttatcgcgaatttttgttaagtcagcagcagcgtgcgaaaaataacgcccgtctggcaaacgtctttaaaacaaaacacctcaatatctgggcgtcggcgcgttcggcgtatttcaacctggtgagctggcagagctgcgaggataaatcactgacccttgagcagttcgaggggcagccgtgcattctggcctttgacctggcgcgtaagctggatatgaacagcatggcgcgactttatacccgcgagattgacggtaaaacgcattactacagtgtggccccgcgtttctgggtaccgtatgacacggtgtacagcgtcgagaaaaatgaagatcgccggacagccgaacgctttcagaaatgggtggaaatgggcgttctgaccgttaccgatggtgcggaggtggattatcgctacatcctcgaagaggccaaagcggcgaacaaaatcagcccggtcagtgagtcacccatcgaccccttcggggcgaccgggctgtcacatgaccttgctgatgaagacctgaaccccgtcaccatcattcagaactacaccaacatgtccgatccgatgaaagagctggaagcggcgattgaatcggggcgctttcatcatgacggcaatcccatcatgacctggtgtatcggcaacgtggtcggcaaaaccattccgggtaacgatgatgtggtgaagcccgtcaaggagcaggcggaaaacaaaatcgatggtgcagttgcgctgattatggcggttggcagagccatgctgtacgagaaagaagacacgctgtctgatcacattgagtcctacgggatccgctcgctttaactgaggtaattatgatcatgctgattctcgcgcctctggtgggcgtgctgggtgcgcttttgctggcgtatggtgcctggctgatttatcccccggcgggttttgttgttgccggggcgctgtgcctgttctggtcgtggctggtggcgcgatatctcgaccgtacacagtcgtctgtcggcggaggtaaatagtgttcttttcgggattatttcaacgaaaaagtgacgcaccggtgaccacgccagcagagctggcggatgccatcgggctgtcgtatgacacctataccggaaagcagatcagcagtcagcgggctatgcgactgacggcggttttttcctgcgtcagagtgctggcagagtcggtcgggatgttgccctgcaatctgtatcacctgaacggcagcctgaagcagagagccaccggcgaacgtctgcataaactgatctccacgcatcccaatggctatatgacgccgcaggagttctgggagctggtggtcacctgtctgtgcctgaggggaaacttttacgcctacaaagtgaaagcatttggcgaagtggctgaactgctgcccgtcgatcccggctgtgtggtatatgcgctgggaaggtgtcagcgatggcctgaaggtgaccgccgggagtgttattcagcgcgatgacctggtgcagtacacgacaactgacgatgcaaccagctccggtggtgtcctgcgcgtgccgatcgcctgctcaagtgcaggtgcggtcggtaacgctgacgacggtacggcattaatcctggtcacgccggtgaatggtctgccgtcttccggtgtggctgacaccctgacaggcggatttgatactgaagagctggaaacgtggcgcgcccgcgtcattgagcggtattactggacgccgcagggcggggctgacggggactatgtcgtctgggctaaagaagtgcccggcattacccgcgcatggacataccgtcacttgatgggaacgggaactgtcggtgtgatgattgccagcagtgacctgattaatcccattccggaagaatcaacggaaacggcggcaagacaacatatcgggccactggccccggtggcaggctctgatttgtatgtgttcaggccggtggcacatacggtggattttcatatccgcgtgacgccggacacaccagaaatacgggctgccattaccgcggagttgcgttcgttcctgctgcgtgatggttatccgcagggagaactcaaggtatcgcgtatcagtgaggcgatttccggtgcgaacggggaatacagccatcagttgcttgcaccggtggacaatatctccattgcgaaaaacgaactggcggtactggggacgatttcatggacgtgacaaacgatgattacatccgcctgttatcggcactgttgccgcccggtccggtgtggtcagccagcgatccggcgattgccggtgcggcaccgtcattaacccgtgttcatcagcgtgcggatgccctgatgcgggagctggatccgcgcaccaccactgaactgataaaccgctgggagcgtctgtgcggtctgccggatgaatgtattccggcgggaacgcagacccttcgccagcgtcagcaacggctggatgcgaaggttaacctggcgggcggcatcaacgaggatttttatcttgcacagcttgctgccctgggcagaccagatgccaccatcacgcgatacgacaaaagcactttcacctgctcatcggcctgtactgacgcggtgaatgcgccggaatggcggtattactggcaggtcaacatgccagccaccaccaactccacctggatgacatgtggcgatccctgtgattccgcactgcgtatctggggtgacaccgttgtcgagtgtgtgcttaacaaactctgcccgtcgcatacctacgtaatttttaaatatccggagtaatccatgcatcgtatagacacgaaaaccgcgcagaaggataagttcggcgcgggtaagaacggttttacccgtggtaacccccagaccggcacgcctgccaccgatctggatgatgactactttgacatgttgcaggaggaactttgcagcgtggtggaggcatccggtgccagcctggagaaggggcggcacgaccagttacttaccgcacttcgcgcgctgctgttaagccgcaagaatccgtttggcgatatcaaatcggatggcactgtgcaaacggctctcgaaaaccttggtttgggagaaggagcaaaactcaatgcagcaacggctacattaggacgcaccggtttcatagctataccggttatgattggtggtattgagcaatcagtaatcattcagtgggggtggaatgccgcaaaagcatctgcctctgggggggatggaaatacagttgtattcccggttgcgtttaataatgcctgtgttgccgttgttgcaaattatgacaatgtcagcgcacctatcaatgcagtggcaacggggggatatacaaccacttcgtttttattacggtgcgcagctcaaacgggtagttattactataactggattgctattgggtattaagatgaaaatatactgttgcttaaataccgttggtttttttatggatggctgtggcgtcattccgccagattctaaagaaataacggcagaacactggcagtcattattaaaatctcaagctgaaggaggcgtgatcgatttttctgtttttcctccttctattaaagaggttatccgtactcatgatgatgaagtcgcagatgcgaactttcaaaagcagatgcttatctctgatgcaactgattttatcaatagcagacagtggcagggtaaggctgcattgggaagacttaaagaagatgagctgaaacaatataatttgtggctggattatctggaagcactggaactggttgatacatccagtgcgccagatattgaatggcctacgcctccggcagttcaggccagatgacatccggcgcggtgctggtatctgttgccgtcaccgcgtcaatgtaatccagcacagcgttaagtctggttgtttctgcctgcgtcagtttacgtccggcctgcaatttcagttgaatcagactaatggaagccattgcagcatcaatcagtgactggcgctgtgcttctgccgcgtctactgcggcgctatgctgtgcttcagtatcggtcacccatttctcaccatcccatttatcgtatggagataaaggggcgatagtggttgtattttcagggtaatcacccggagctttgatttcttttgattctccagttttggtgctatagaccgtttcaccgcgatggtctggcacatattcccatgagttaaaatctgcagaacggcagattgcataaccagccttatgtgtaccaggggcatctaaacaggaacatgccggaatgccgacaccaacggcaagatattcatttgaagtggaaatatattcccgtgtttcaccatcgtagttataaacggtaacatcccctgcctttgttgcaataaggtcactatttaatattgctttatgcatcaggctgccctcacgatatagttaaatgcaatattacgcggacgcgtttctgaggctgcggcacctaaaccatccactgattgtttatatgttttaaaggttccataatccggggctggtaatccggcatcgtttgtgtttcctcttttgataatgtcagtgccactatttacccatatttcatcaaaatagaaattaatcgttgcatcagtcacaatcgtggatcttgacggtaatccatgagcatgatcctccgttgcatacccctgaatacttaaaatagagcgacctgtatcaatcccccgcccgtcatcccagccacgaataaactcaccacgtaaatcaggcaatttatttgtcggataagcctttgccagttccgggtattcttcagcagaaaaagcggcaccattgcatttcagccagcctgttggcggagtggctgaaggccacggaaccgggacaccaacaggtaatgcagagccttctcccaaaccaacgtttatgaaaatgaagaaataacaagcaaatggcatcattcctgcttttaccagggggatttaacatgcttattggctatgtacgcgtatcaacaaatgaccagaacacagatctacaacgtaatgcgctgaactgtgcaggatgcgagctgatttttgaagacaagataagcggcacaaagtccgaaaggccgggactgaaaaaactgctcaggacattatcggcaggtgacactctggttgtctggaagctggatcggctggggcgtagtatgcggcatcttgtcgtgctggtggaggagttgcgcgaacgaggcatcaactttcgtagtctgacggattcaattgataccagcacaccaatgggacgctttttctttcatgtgatgggtgccctggctgaaatggagcgtgaactgattgttgaacgaacaaaagctggactggaaactgctcgtgcacagggacgaattggtggacgtcgtcccaaacttacaccagaacaatgggcacaagctggacgattaattgcagcaggaactcctcgccagaaggtggcgattatctatgatgttggtgtgtcaactttgtataagaggtttcctgcaggggataaataaagttaaagacactttgtgtacaaaagaaagtaaaacaacagcaacttgttgcaattttatcaataaaagtagtattgtcgtgaaaaattgattaaagattaatattatgcatgtttttgataataatggaattgaactgaaagctgagtgttcgataggtgaagaggatggtgtttatggtctaatccttgagtcgtgggggccgggtgacagaaacaaagattacaatatcgctcttgattatatcattgaacggttggttgattctggtgtatcccaagtcgtagtatatctggcgtcatcatcagtcagaaaacatatgcattctttggatgaaagaaaaatccatcctggtgaatattttactttgattggtaatagcccccgcgatatacgcttgaagatgtgtggttatcaggcttattttagtcgtacggggagaaaggaaattccttccggcaatagaacgaaacgaatattgataaatgttccaggtatttatagtgacagtttttgggcgtctataatacgtggagaactatcagagctttcacagcctacagatgatgaatcgcttctgaatatgagggttagtaaattaattaagaaaacgttgagtcaacccgagggctccaggaaaccagttgaggtagaaagactacaaaaagtttatgtccgagacccgatggtaaaagcttggattttacagcaaagtaaaggtatatgtgaaaactgtggtaaaaatgctccgttttatttaaatgatggaaacccatatttggaagtacatcatgtaattcccctgtcttcaggtggtgctgatacaacagataactgtgttgccctttgtccgaattgccatagagaattgcactatagtaaaaatgcaaaagaactaatcgagatgctttacgttaatataaaccgattacagaaataaaattatttattaaagtcacatttaagacgtaataccctacagggtaaaaattttctctgatcttaacttctgcaaatgttaactgctatttttatgctaaaaatggttatcaaaactcaaaaacacatgtttataatcaatgagttatagaaatgctaagggctaatgagttatatgcaaattagtaaaattatgttgctatgtcagatagttacgatttagtcatctaactaatgctgcgccatatgggttggactgaagcggctgacctgattgttaaaggtatggaaggcgcaatcaatgccaagaccgtaacttatgacttcgaacgtctgatggaaggcgctaagctgctgaaatgttcagagtttggtgaagcgatcatcgaaaacatgtaatctctccatgtgttaaatattgaaacgggcgtataacacgcccgttgttttatttatgtggatattattaatagcatatcgagcatatttatatgaagcccattacttgagcccatatgggcatatttttataatgcaactattatgtaaacatttatttgttattttgctttctcctggaggacactcttgactgcttttgagtaaactccataaatccttgttgaatggtgcgatgtgataaatagtaataggatattctttatccttaaggataataccagacttaaccggtgtaaatatactgccaggagggagaaatatagtagattgataccagatgatcattttcatattaccccatatggctgaaaaagatataccacatgtaggttgaattaccgtgtcaattactatccacttcatttgttatgtcttatcccacggtatttaatatggttcattaggatgtttatttcttgattttgcatatgagtatattacccccccctcaaaaaaataaattaattaaaatgatggcttatataaaataaaatttaaagcaaggaatctcaatggatgttaaacaaaatgagattttgtgaaagcaataaattattgacttcgttttagatttgtttagctataatgttatacattcaaatgactgaacatcctgtaattaaaacatagcctttatgctactttgtgccaatttgctaaacattatggttgcctttttatataacgataataatgaatataagcatgacatgagaataaggtttcaatttttgagttatataggaatgatttaacctgttcctggctaaaatacatataaccggatgatgactaaaccaaaatacatgtgcgttaagtattgaaacggacgtgtggcacggccgttgtttttataaatatgttaaccgttataaaataacgtatcaaaagtcaagtgatcacatttcaaatatcaagttgatagtattagtctggtgattatttatgggtgacaataaaaagacagtattaatcatccatagagatagtctctgcacttttatttccattatgctaatgccttactgaattatgaagcatttcttaagtatccaactttagctagattaatggtttattattttctacatcttcaatatataaaagcgtattatcaatggcgtagtaactgcgtttgttatgattaacatcagtaacccaccggaaaacgcccgcgcctgccagtgttgaacagtattcccgaaatgtagattttccgcaaatatgaagcaatgcggcctcttttattttagcagggttcttggtcgtactaacttttaacaggttcctggttcctcttaataacaaaaccgtatcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttagttgtgagactgcgtagtgtgcacgatcggttttaccacttcaatctggtctgtcctttggctgtgatatgtacagagtgtgatagagggaatatctgaattctcccggtgagcattttgcaacggaccagctccggtacaaacgctgttgtgggttcagattataacattctgtctaaggggcgggataaaggtgaaattagggggcatgaaagatgactttataaccttgctcaccccagtgttgtaaaagttcgttttgccttctcgttggtgccatgcctgtccagacaatcaatgtttgcgtcgggaacagttccgggcgcggcgattcaatgggatcagcaagaacagaaatgtgccatcctgacaatgataaacgccatgcttccagccacaatcgtgctctctcttcaacattccacgccatcagaatggcttctttaccgggcttacggcgcatttcgaaaagcgaggttgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattctcgcgcgtagtttggcaggattagccatgcgaagaattgacatcatctcttcttgcaggcggctccagtcatcttccgtatcctggctggtggtttccagtaatgctttaactttgcctacagggacgccattacttatccaacgcttgatctcttcgatgcgttgtatgtcttcttcatcaaagagtcggtgtccgccttcactgcgctgtggttttaacaaaccgtagcggcgttgccaggcccggagagtgacaggattaatcccgcaacgttcagcaacatcaccaatgctgtaataagccacaattcctccttgcggtcacaaatctccgtcgcctgtacacgacccaataatactttgtacaatatacgctaaaattgtacaaagtataaataagatttcagctaaattggatgaaacattatttttaatgtggattaaatttaaacgtaacgtattcattttcacgatgatttactgaaatcatgtgaaagaatgtgctgaaaattattttttctctggccacgctatggaagggataccattcaatttagctttagcaaacagatctccctgaaacatctcaattcctgcggattcaagccacatccactcttctggtgttgccacgcccatagcactgacttgaatttcaagtgatgtacagcattttatgatcgcctgaataattgcctgccgtggcccacttttatgaacattggtaatcaattcctgactgattttaattctgtcaggctggaagcgtgacaggagtaacaaaccagcaaaacctgcgccaaaatgatcaattgctacactgataccagcagcctttagcgatttaatcgcttcggcaaactcatcaaaccgagatatgacttcactttcagtaaattcaacgatgatttgttcaggcaccagagcattggcctttatttcattaagtaaaaaagagactgcgtcaggttcgttaaccagggtcataggtaatagattgattgaaatcattttatcaccgagctcaagtgcgtgtgccatcgtgaatgcaagcgccttacttttgagatccgctgtgtagatttccccgtctttacgctgcccaaccgctatggctgatgggctatcttcatttttttgcacaatggcttcaaaagcgattatccgccgcgataagggatcgacaataggatgaaaggcaaagtggtcgtttatagttggtgaaagggcacaggaatcaagttctttatcagatccgtcagcgataaaaagccaggagtcttcggcagggatctcgaaataggttgattgttcggttgcaaggacaaaagtacgaaaaaattgtagcgctctgtcatcataagttagctgaaattttgatgtgcctttgtcgaatacggcctgtaaaacgtcatctcgctcgtgcaggcgcaaatcaaataattccattcccgctttgccaaaacggcgagcaggcgcgtaatcgcacagcagctcaacaatattatagtgccgtggatcctggcatatagcccgatatatcattttaacctgttcttccggaccttccagaagctggaaaaaatgagaaccattaaacagtaagatccctgttacgtcagactgcatgttcctgcgatttgctatcgaaaccatttcttcgatttttttgacaggttcgtcgtcacgtatatggctacgataaataagggtggtaagcattaacaatccagggtaatgggtgaggcgagagtaagacggtaacagacatatcttcttgtgtctttcttttaataccaaaacataaccgtttctttacattgataaaaaatggaaaaagttgaacactagttggcgaaaaatcttgtatagattgtcagttaaatgatgcaatatgttttatcataacacattgttttatatgcattagcactaattgcaaaaaattaatttatcattctgtacacatatttcgtacaagtttgctattgttacttcacttaacattgattaacatttttaacagaggcgtagcatgcatcaaaattcagtgactttagattctgcgggagcaatcactcgttactttgcaaaagctaacttgcatactcagcaggaaactctcggggaaattgtgactgagattttgaaagatggacgtaatctgagtcgaaagtcgctttgtgccaaacttctttgccgactggaacacgcgactggggaagaggaacagaaacattataatgcactaattgggttgctttttgaataatgcaacagcctgattatttaacaggttagctatgaagtcgttatgaagacatctgataatgaacgtataaaatatgaaattactggccaggcggtgctccagatactgcgcatgaagataaatttttcattgcagactcttattaagcaattactcgtaatgaaatcggctgaggaagatgctttccgacgcgatttaattgacagcataattcgtgattttagcaatagtgattcaggagggccaaaccgaagaacagcgacagctgacaataaaagtatgttcaatggtaagaaaataaacagaatacattaaaatttcataagtaagatgagaggttaccatgcttgaagatactacaattcataatgcaataactgataaagcgttagcaagttactttcgcagttcgggtaatttgttagaagaagaatcagcagtgttagggcaggctgtcaccaatttaatgctttcaggcgataatgttaataataaaaatattatcttaagtctgatacactccttggaaacaacaagtgatattctcaaagctgatgtgattagaaaaacactggaaatcgtgttgcgatacacagctgatgatatgtaacttctaattattaagtataagtttatagaaaactcattcatcttatttttgtctgtcgctttagactatacacagcataattttattgggttaatatttctacgaggctgacatgaataattcaatcccagagagatttatttttcaatgtgctttgtttaaaaatctcgagagggaggtgttcatgacgcatgggtatgttgatagtcatattattgatcaggctttacgcttgcgtttaaaagatgaaaccagtgtgattctttctgatctctatctgcaaatattgcagtacattgaaatgcataagactacactaacggatatcattattaatgacagggaatccgtgctctcttagaacttgagtaaggttttagaataaacatcagctgtatcaccatgctgatgcaaagtgagcatttcaggcgttatgctttcttattatgtccgcaatatcaggtgtcaagaatggagagttctcgctctccattcttgacgcctgatatcccgcctaacttattttgtactgcctacattatgctcaataattaatgggttagatcaagatggagaaaattttatcttcggcgtggatatttcttatgctctctaccatgctctctgtagatgccagcgcgagcgaatgaatggcattttcatgtattaaaccctttggccgggacaagcaaatgcgcaatacactcatacccatcctcgttgcgatatgcttgtttattaccggtgtcgctattttgaacatccagctctggtattccgcaaaagcagagtacctggcgggagcgagatatgccgccaacaatatcaatcatatacttgaagaagcgtcacaagcgactcaaacagcggttaacattgccgggaaggaatgcaacctcgaggagcaatatcagcttggcactgaagcagctctgaaacctcacctgcgcacaatcatcattctcaaacagggaatagtctggtgtacatccctgcctgggaatcgggtcctgttgtctcgtattcctgttttcccggacagtaatttactgttggctccagcaatcgacaccgttaatagattacctatcctgctctatcagaaccaatttgcagatacgcgcattttggttacgataagcgatcagcatattcgtggggcacttaatgtacccttgaaaggggtaaggtatgtattacgcgtggcggatgacattattggaccaacgggtgatgtgatgacgcttaatggacattatccctataccgagaaggttcactccacaaaatatcatttcactattatctttaacccgccgccactctttagcttctacagacttatcgataaaggctttgggattttaatatttattctgttaatcgcctgcgccgctgccttcctgcttgatagatatttcaataaaagcgcaacgcctgaagagatcctgcgacgggcaataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatccggattaatcgttccgcttacgcaaagcctgatgaatcaggttgccagacagatgaacgctatcgcgagtaaattgccggaaggttttcatattggaattaattttagcgcttcgcatattatttcgccgacgtttgtcgacgagtgtttaaatttccgtgacagttttacccgccgcgatttaaaccttgttctggaagtcaccgagcgtgagccattgaatgttgatgaaagtctggttcagcggttgaacatactgcatgaaaatggttttgtcatcgcactggatgatttcggtactggctactcagggctttcttatcttcatgacctgcatattgattatatcaaaattgatcacagtttcgttggccgcgtaaacgcagacccagaatcaacccgaattctggattgtgtattggatctggcgcgtaaactttcgatcagtatcgtcgctgaaggtgtcgaaacgaaagaacaacttgactatctgaaccaaaattatatcacatttcagcagggttattatttctataaacctgttacatacatcgacctggtcaaaattatcctttctaaaccgaaggtgaaggttgtggttgagtgaaaattgatcagtaaggccatagtgcggtgtaattatagacagctaattagctcgttgcctcttgttactattgttcattattttgtttgctataattgtttgaaagttttgacaggattgccattagtagcatgaacaatagtaataatctggattatttcactctctatatcatattttccattgcatttatgctgatcaccctcctggtcatccttattgcaaaacccagtaccgggctgggagaagtgcttgtgacgataaatttgcttaatgcccttgtttggctggcgatcaatctggttaatcgattaagagaaagactcgtcaaccacagggatcagcaataatctttcagtttctcactgtcagtatgcggctgaatgggttgctggcagtgaacgcctggatcattgaaggaaaggcattattgcgcaaatagttgtcaaccctggtgttatcacggttgtttttatatatcaccgaaataatcctcatcgcaactattaacaattttgatgtcgaagagttatttgttaaacaaaatcgtcacctcaaagtgatcaatgtcatgaaaataaggtgaaaaatgataatgccgacttatttatcatttatatattgtcgctgtttatctatttaaattttttgtgcttttgtttttgtctttaccctccgttttggtaatctgagctcataggttatttgaccaggaatgtttgttaatccaatgaatggatggttaatctatgaaactgaaaaaactccccgggtttagtttgggacttattgctctggcggtgggtaatgcatatgcaacacaattgttggatgattatagtataatttcctatatgactgatgaagaatcgccgattgaaatcaaagataataatccgataagtaatggagagtatctaaccactgaagacgaaagccatgctgtgaaagtggatgacggtgtaactggatatataaataatgccagtgtgatgactagtggtgatggatcttatggtatttctgttgatagtcaaaacaaagtattatatataagcgatagcgatattaagacctctggaagcgtatctgacaaagaaaatggagggataacagccagcgcagtagtcagtgaatttggtggcaccatctttatgaatggtgataattcagtcgagtcgggtggggcatattcagcgggacttttaagccaggttaatgattctgaaaagatggtaaataacacccgtcttgaaaccacagataaaacgaacattgttacctctggggaaaatgcagtaggtgttcttgcatgttcaagtcctggagagtctcgaacatgtgtcgatgctgtagatgatgaagttagtgattctaacagttacgaagttattagccgtgctgatttaaaaatgaatggtggttccataacaactaatggcattaatagctatggtgcttatgctaatgggaaaaaagcatatattaatttagattatgtggcacttgaaactgtggctgatggaagttatgcagttgctattcgacaaggtaacattgatataaaaaatagttctattacaacaacaggcactaaagcccccattgcaaaaatatacaatggtggagagttatttttttccaatgtcaccgcggtatcaaaacaagataaaggaatatcaattgatgcatcaaatatcgattctcaagccaaaatagcactattaagtgttgaactttcaagtgctttggatagtattgatgttaacaaaactacaacggatgtaagtatccttaatcgaagtattatcacacctggtaataatgttctggttaataatactggaggtgacttaaacataatttcgtccgactctattctaaatggagcgactaaactcgtcagcggcacaaccacgctgaagctttcagaaaatacaatctggaatatgaaagatgactccgttgttacccatctgactaattcagacagtattatcaatctttcgtatgatgatggtcaaacatttacccaaggaaaaacattaaccgtaaaaggtaattatgtcggtaataatggtcagcttaatatccgcaccgtattaggtgatgataaatcggctacggacagacttattgttgagggtaatacttcgggttcaactaccgtctatgtgaaaaatgctggaggaagcggcgcggccacgctaaacgggatcgaactcataactgtgaatggcgatgaatctccagcagatgccttcagataaggtgatgcaaggattgcagctggagctttcgaatatcaactaaaacaacaaggcaaaaactggtatttgacaagttatcagtcagtgaatgaggaggataacagctcagagggaaattcagaatcaacagaaacgcctacccccgtcctgcgccccgaagctggaagttacgtcgctaacctggcagctgctaacactctttttgttatgcgtctgaacgaccgtgcgggtgaaacgcgctacatcgatcctgtaactgaacaggagcgttcaagccgactttggctacgtcaaattggcgggcataatgcctggcgtgacagcaacggacagttgagaacgacctcgcatcgctacgtctcgcagttagggggcgatctgttaaccggtggttttaccgatagtgacagttggcgtttgggagtgatggctggttatgcccgcgactacaacttaactcattccagcgtgtcggattatcgttcgaaagggagtgtcagaggctatagcgcagggctgtatgccacctggtttgccgatgacatcagtaaaaaaggcgcatacattgactcctgggcgcaatatagctggtttaaaaactcggtgaaaggggatgaattagcctatgaatcctatagcgcgaaaggtgcaaccgtctcgctggaagcgggttacggttttgccctgaataaatcctttggtctggaagcggcgaaatatacgtggatcttccagccacaggcacaggctatctggatgggcgtcgatcataatgcgcacacggaagccaatggctcacgtattgagaatgacgcaaataacaacatccagacccgactcggcttccgcacctttattcgtactcaggagaaaaacagcggtccgcacggtgacgactttgaaccttttgttgaaatgaactggatccataacagtaaagattttgctgtctcaatgaacggtgtgaaagtcgaacaagatggggcgagtaatttgggggaaattaaacttggcgtaaatggcaacctgaatccagcggccagcgtctggggaatgtgggcgtgcagctgggtgataatggctacaatgacaccgcagtgatggtgggcctgaaatataagttctgatcccgccgttagctaaaaaaccgcgtcgtattcatcgacgcggtacatatgaaatattattttttgccgatagcacgcatggtgtcatcaattgccgtgatcaacagcatttgcgggtctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgacggcaaaccgtttttaatattgtagtcctgcgcccaggtcattggtgcgaaaacaaacaggcccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcggttcatatccgccatcgctggcgtggagcagaacaatgctgagataagcccgaaggcaagtatttttttcttcaacttagatgtccggtattaagtaagttgcacacacaataatttcgtcttcaattaagatctgcttaactaaagaacgctcgctattattcagataattcaaaatgagcgtggctgtgatgataggaattatgttttttacgtgaatgagaataatcttaaatgaggaataactcattgattgacaatatttttattcaagaagtgtcattgactgttaacgcaatgttgtaaaggtaagataatctgatttatcaatattattgtgtgatttttatgtgagcagaagatattcatcagcaacgattacattagtcattttattttgccgacggcctcattgtcgaaagataagcgtacgacagtattatcagaaaagagtgattttttatccaactacacttcagcgcactgcgtgtaaaaaatgcctctttcttatgcgggatatcatcatttcatcatgatgtctttggtgagcggtgaacacaatacacctgcgctgtctcttcaggatgaatcccctggtctggtgcctgcgggctgatgttgcagcagagcttaggtcacttagacgctactatcatttatccaatggcatggaatcgaaatcagtcgatacccgcagtatatatcgtgaactgggtgcaacgctgagttacaacatgcgcctggggaacggtatggaaatgaaccctggctgaaggcggctgtgcgcaaagaatttgtcgatgataaccgggtgaaggtgaataatgacggtaatttcgtcaatgatttgtcgggcagacgtggaatataccaggcagctattaaagcctcattcagcagtacgtttagcggacatctcggggtggggtatagccatggtgccggtgtggaatccccgtggaacgcggtggctggtgtgaactggtcgttctgaccatcaacgattaaactgcgcttcggcgcagttttcgtttacaggatgttgaaagggaaaattctggggcaaaaaaagcccgccagttacggcgggaaacctcatcctatgggagaacaatgaataatgaaattgcggggttatcatctcccagtatatccatactaacaataaggttatttactcaaccaggcataaacattttgttttgtgcgtgggaacagccttaaggtgtaaagggggaggtggaaatagcaatgaggagtatcagcaagaatactcgccgctttaccacaacgtggatgagagggatgaaaaactcaaggcagagataactctgccttgaagataaatgcgcttttacagcgggcttatttcagctcttctgcttccggtaaggtcacgttcagctcaagaatagaaatatcgccatctttttgctcaagctgtacggttaccatctcaggatcaatttgtacgtatttacaaatgacctcaagaatatctttacgcaactgcggcagataatgcggttctgcatcgctgcgacggcgttcagcaacaataatctgcagccgttcttttgcaatgttggctgtgtttttcttccgcgagagaaagaaatcgagtaatgccataacttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaataggctcttcgccattttctgcgcggcgtgatttcgacgccagaatgcctaaaatacggtcagagtcgcgtactgaggagacttccgggttggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatctttatcgcgtgtttgcgatgccggcagaatatagagattttcagtacgcttatctttaattaacgcctgatttagcgttgcatcgccctgaatgacgttgacgaaatcgtaaacgacccggcgttcacaacccataatcaggtcgagattacgcaggccgatatcaaaatctatcacgacagttttctttcccttctgggccaaaccagtggcgatggccgcgctggaggttgtcttaccaacaccccctttgcccgaagtaacaacaataatgcgtgccatagaaattccttgttaaaaagggatcaatttaacggttgaacggtcaaagcgttttcgactaactgcagtcgcgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttcccatcggcaatcaattcggccccagcgctaacgtggcttgtaacaatcagatcacattgtggagcataaatacgctgaccggaacgcaccggggtatctattaaacgcgtttttgtgaccggcgttgtattttgcgctggagcctgcggtgtgggagctggacgtggcgctttttcctttccttccgtcaggataggcagccccatcttttcaatttcggctttaagttgcgcatctttgcagccacttacgccaataacccgcaaaccggttgccgaaaccgccttatgcatcgctgaccagtttaccgggtcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatctccagacctgtttaaatatccagtattgaggcaagtgtattttttcaccacgccaggctttcttaactttccattttttgcggcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcggacttcaatctccggcgtgcggcgttgtttgcgacccgtatatttgtgtgaactcagatggcatttccccagagttaacaaggaaatatctcggcgaaaaagccgctgaaaacttacaatcattacaaggctacgatcccagcgaatttacattcgctaacggtgtattttgcgatgttaaagaaaaattatgtcgtgatgatcgttattttggtgtggatggtaagcggagtggaaaaatcaatcaaaccaccacaaagatgttatttatgtgtcgtgagtgatgtcttgtttacattatgttctattcgtcattaacctcttgagcgacagagaggagtggggcattaacgtttatgacggggagagtccccgtcggttgacatttacttaatttgaatatcgacgttatattttttagttttgtttttacgggcgtcgtttcgggtttgcaacactcgcagctcatatttgccagaagcagggagtgagtattgtccgtgactatcgagttctggggaatatctggataaatcaactgaatcatcgattcctggcccgaagaggtaagtatcagcgccttcattagagatactcacatgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaagcagcaatacagccttcctgatgctcttgattttcattggtagtctcctgttcagaatgagtacgatgaactgttataatataacaatccctaacgggagaattccagtggctttcctgcgttcggtaaaatcacgttgcggcatttttgccggggggattacttataaagggggcatggactcaacaaaccgtagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattctgccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacactaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtgcccgaagagccagtgctgtttattaaaccagaaacggcactgtgcgatctgcggcagccattggcgatcccatccgatttcggttcagttcatcatgaagtcgaactggcggtgttgattggcgcgacactgcgtcaggctacggaagagcatgtccgcaaagccattgccggttatggcgtggcgctcgatctgacattgcgtgatgttcagggaaaaatgaagaaagccgggcagccgtgggaaaaggctaaagcgtttgataactcttgtccgctttccgggtttattcccgcggcggaatttaccggcgacccgcaaaatacaacgctgagcctgagcgtaaacggcgaacaacgccagcaaggtacgactgcggacatgatccataaaatcgttccgctgatcgcttatatgagcaagttttttaccctcaaggccggtgacgttgtgttgacaggcacgcctgatggcgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaagatttacctgcgtggcatccgctacttactggttcgaaagcggcaatgcatggtgaacgtatctctgtgcgtcatatcgcagtgaaagaatcagaagtgattgactggcaggatcatatcttaaataaacctgactgggcgcagtgataaatttaatagatgctgatgggggctttcttaatatacgtctggatgctcgccatttcgtagccctgtttttgaaagcgctctgtcataatgagagttacccgataccttattatcaacaggtaactctcaatctttaaaaaacgtctgtgtttttaaatgtgataaaccttataccttgagtacatggagagaataatcgcttatcagacttcaggtacctcaaagagtgtctttttaccgtgtcttttctgatactcattacaggtgttaatcatttttttggccgcttcttttagcaaagaaagcattaaatcatcataatcaacgtagaatctggttgtttcagtttccgtttttatctcaccgatggcggctatttcggtggttaatttcaatttggcggcatcgatatctttattcgcttgtttaaccgtgttagacagggtggtaaagaaattctgcacagattttaacttgttcttcaattctggaatcagttttccttcaactacgcccgcagcaatagaataggaaatgattaatccaaatggaccggcgacgacaccggctgcggcaccggcatatgcttccttcctgattttatctacctgtgactggaaatagctgcttttttctgaaaaatcattggttaactggctatctaacgccagcagtttcccggaagcgttgttgaaactttgtgagcttaccagcagggatttttgcgcttcattcagcttcgtgatgccgtcatccagtaccttaatgagaatgtctttctgggcggatgctttcttctcattgtactcatcaaatagcaaaatatacgctgcgagcaattgcgtcgcaacaccacaccattcatacactgtttgggttgcttcaaaatacttatcctggctatccataagtaaggttttaatatcgccgactaaaacggaggctgcctgtgaatactcctgtttaaagcgacttaactcttttatggtttcatcaaaggtctgccaggggatgacctgatcgagatatttattataaagatctaatgctccatctgcggtttcgattgcgtttttaactacttctaccgttttatctgcaacgatttcagtcataatcattcgcctctttaaatatataaattgtaatgaaactcctgttttacaactattaataaattttacttcatctaattcatagttagccgggcgggatgcgtcaatgtctttatttctattaatatgataaatatcaaacaatgtttaatgtcattatggcgaatgcttctattctattttttagccgggtgatatttttcatttctgctggatgagcgtcgtcgccagaaggccacgtgagcacaagataagagaacgaaaaatcagcagcctatgcagcgacaaatattgatagcctgaatcagtattgatctgctggcaagaacagactactgtatataaaaacagtataacttcaggcagattattatgttgtttatcaagcctgcggatctccgcgaaattgtgacttttccgctatttagcgatcttgttcagtgtggctttccttcaccggcagcagattacgttgaacagcgcatcgatctgaatcaactgttgatccagcatcccagcgcgacttacttcgtcaaagcaagtggtgattctatgattgatggtggaattagtgacggtgatttactgattgtcgatagcgctattaccgccagccatggtgatattgtcatcgctgctgttgacggcgagtttacggtgaaaaaattgcaactacgcccgacggtacagcttattcccatgaacagcgcgtactcgcccattaccatcagtagtgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagagctatcgccccgcgtcgagatttacagtattgatgaggcattctgcgatctgacaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataaatatagcggcaggaaaaaagcgctcccgcaggagcgccgaatggattagcgaccgaacagatcacgttttttcgctttaaacggctgggaaatcaccaccagcactgcgacaatcaggtaagcgataaaaataccgagcagccactgcggcatttccagacctaaaaaatcccactgacgctcggcgcaatcgccagaggcgacaaacacttgcggcacccacttatccagcggcagccattccgggaaacgaaccataaaatcacaggtggcaaacggcgaaggatagagctgaagcatggtgtgctcgtaagttaactgcacaccgcggaacgcactatacaaccagataaccatcgctacataacgcagcggagttttcggggcgatcgcgccaatcagcgcagcacccagaacgccgaataacgcgcagcgttcataaatacagagcacgcaaggtttcagtaacatcacatgctggaaccacagcgccgtcagttccagtgccagagcagtaaacgccatcaacagccacgcgccccggccttgtgaacattggttcaaaaatcgcaacataatcatttccctgcaatatgcatagagtgcgcagtttaaaccaattcattcgctgcgccaccaggaggcagcaaaaataggacgcaattggacaattatcgggcgaaaaggcaaaccgggcatttatatgcccggtaagttgttatcaaagcgttgctatccagcccatttgcataaaccattcggttacaggggcaagcgtaaactcgacgcagagcaagccgacgagtgtcaggacgagggtgtaaggcagggccatccacaccatgcggccataagagaggcgaatcaatggcgcgagtgcagaggtcagcaggaacaggaacgcagcctgaccgttcggcgtagcgacggagggcagattggtaccggtattaatggcgaccgccagcagctcgtattgcttcaacgtgatagcgccactttccattgccgctttcgcttcgttgatataaatcgtccccacgaagacgttatccgaaatggatgacagcagaccgttgaaaatatagaacagcgacagctgagcatgttccgatgcctgcaacacaaactgaataattggcgaaaacagttgttggtcgataatcaccgcgactaccgagaaaaacaccgtcaacagtgcggtgaatggcagagattcggtgaaggctttaccgatagcatgctcatcggtgacaccggtcaatgatgttgccagaataatgactgacaaaccaatcaagccaacttccgccagatgcaacgccagcgcagtcaccagccagacgccaataatcgcctggacaatcagacggattttatcctgacgggtacgctggtggcggctttgatcgtcaaactgttgcaacacttcgcggactttctccggcagcgtttcaccgtagccaaaccaacgcagcttctctaccagcaggcaggttaacaggccacaaatcagaaccggaacggtcaccggcgacatgcgcaggaagaaatcgccaaaatgccagccagccgctttagcgatgatcaggttctgtggttcgcccaccatggtcattacgccgcctaatgcggtgccgacaccggcatgcatcatcaggctacgcagaaagccacggaactgttccagaaccactttgtaatgcttgtcgatatgactatcgtcttgcaggtcggtgtcttcggtacgggaagaggctacgcggtgataaataccataaaaaccgactgcaacgctgatcaccaccgccacgacggttaaggcatcgaggaacgcggagaggaacgcagccgccacgcaaaaagagagcgacagcagcattttggagcgaatgcttaacagcaaacgggtaaatatgaacagcaacagctgtttcataaaatagatacccgccaccataaacatcagtaacagcaagacttcaagatttgccgccacctcttcacggacgtgttccgcgctggtcatgccgatgaataccgcttcgatagccaacagaccaccggggagcagcgggtagcatttcagggccatcgccagagtgaaaataaattccgctaccagcaaccagcccgcgacgaaagggctgatgaggaaaattaacgggtttacgattaagaaaatgatgagggcgagtttgtaccagtcgggggactggcccaaaaaattgcgccatagcgcgcggccccaggagatctccatgatggtttcccttaccttacaaataatcaatgatgtttttatgtttaaacgcaaagcttaacggtcaggcaggagtgaggcaagtcttgatagtcaaggggaaagagatgcggaaaatgaagccttgatccctttttcttctttttgtctgctatcagcgtagttagccctctggtatgatgagtccaactttgttttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacagcgtctggcacgagatggctggttgaccattcaacatggcaagccgacgaaggtgaataatttctgggaaacttccggtttaaatatccttgaaacactggcgcgactggatcacgaaagtgtgccgcagcttattgataatttgctgtcggtgcgtaccaatatttccactatttttattcgcaccgcgtttcgtcagcatcccgataaagcgcaggaagtgctggctaccgctaatgaagtggccgatcacgccgatgcctttgccgagctggattacaacatattccgcggcctggcgtttgcttccggcaacccgatttacggtctgattcttaacgggatgaaagggctgtatacgcgtattggtcgtcactatttcgccaatccggaagcgcgcagtctggcgctgggcttctaccacaaactgtcggcgttgtgcagtgaaggcgcgcacgatcaggtgtacgaaacagtgcgtcgctatgggcatgagagtggcgagatttggcaccggatgcagaaaaatctgccgggtgatttagccattcaggggcgataatcccttccgtttaaagagcaaacccctcaaacgaggggttttttgttgtttttacagatttcccattcttggcgggcaacgttccagcaactcgatgctgccgtcttcgttttgctgttcgagcatcacatcaaatccccacaggcgatgcacatgcttcaggacttctttgcgcccccgatccagcggtgcgcgattatgtggaatataacgcagcgtcagcgaacggtcgccgcgcaaatccacgttccagatctgaatattcggctccagattacttaagttatattgcgacgataaccggttacggatctcccgataaccttcttcattatgaatagcggaaatctccagataattatgccgatcgtcatccagcacggtgaagaagcggaaatcacgcatcactttcggtgacaggaactggctgataaaactctcatctttgaaatcacgcatcgcgaaatgcagcgtttccagccagtcggaaccggcgatatccgggaaccagtatttgtcttcttccgttggcgactgacaaatccgtttaatatcctggaacatggcgaacccgagggcatacgggttgatgccgctgtaccacgggctgttataggggggctggaagaccacattggtgtggctgtgcaaaaactccagcataaaacgttccgttactttcccttcatcatacagatggttaaggatggtgtagtgccagaaggtcgcccagccttcgttcatcacctgagtctgtttttgcggataaaaatactggctcaccttacgcacaatacgcaggatttcacgctgccatgattccagcagtggcgcatttttctccataaaatagagcaggttttcttgtggttcggacggatagcggcgcgcttcagcaaccgttttctcttcctcgcgcttcggcagggtacgccagagcatattgacctgactttgcagatactcttcgcgacttttctgccgggctttctcttcttgcagcgagattttttgcgggcgtttgtaccggtccacgccgtagttcatcagcgcgtggcacgagtccagaagccgttctacttcatcaacgccataacgctcttcgcactcggtaatatatttacgggcaaaaatcagataatcgacaatcgaactggcgtcggtccagctacggaataagtaattgtttttgaagaaagagttatgcccatagcaggcatgagccatcaccagcgcttgcatggtaatggtgttctcttccatcaggtaagcgatacacgggttagagttaatgacgatttcataggccagtccttgctgaccgtgcttatacagccgttcagtctcgataaactttttaccgaatgaccagtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaaacgtgtggtgtccttattcatagaatcgatcgtcgccatacgcgcacctcattgttgtcggcgctctctgtgtggagcacctcatttcaagcatagaacacctgttaaaaaccgcgtcgccggagaatttttttctttgcgatttcttattatcagagtgccactaatccgcttctgaacggaattttatgctggataaaaagggcgttcagcaggagatactaaagacgccatattgccgcagagtcagggagatgtgagccagctcaccataaaaaagccgcatgttgaataatattttcaactgagttatcaagatgtgattagattattattcttttactgtatctaccgttatcggagtggctatgcgagttgtcatactgggaagtggtgtggtaggcgttgccagcgcctggtacttaaatcaggcaggacatgaggtcaccgtcattgatcgggagccgggggccgccctggaaaccagtgccgcgaatgccgggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactacatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaatgcgacccgcgatatcgccgtgctggaagatgccggcgtaccgtatcagctgctggaatccagccgcctggcggaagtggagcccgcgctggcagaagtggcgcacaaactgacgggcggcctgcagttacccaatgatgaaaccggagactgtcagctatttacccagaatctggcgcggatggcggagcaggcgggggttaaattccgctttaatacgcccgttgaccaactgctttgcgacggcgagcaaatctacggcgtgaagtgtggcgatgaagtgattaaggccgatgcgtatgtgatggcgtttggttcttactcgacggcgatgctcaaaggcattgttgatattccggtgtatccgctgaaaggctactcgctgaccattccaattgcgcaggaagatggtgcgccggtatccaccattcttgatgaaacctacaaaatcgccattacccgtttcgataaccgcattcgtgttggcggaatggcggagattgttggttttaataccgagctgttgcaaccgcgtcgtgaaacgctggagatggtggttcgcgatctctatccacgcggcggtcatgtcgagcaggcgactttctggactggtctgcgcccgatgacgccagacggcacgccggttgtcgggcgtacacgctttaaaaatctgtggctgaataccggtcacggcacgctcggctggacgatggcttgcggttccggtcagttgttaagcgatctgctctctggtcgcacgccagcgatcccatatgaggatctaagcgtagcgcgctacagccgtggatttacgccatcacgtccgggccatttacatggcgcacacagctaaggaaacgagatgacccgtccgatacaggccagcctcgatctgcaggcattaaaacagaatctgtccattgtccgccaggccgcgacgcacgcgcgcgtctggtcggtggtaaaagcgaacgcttacgggcatggtattgagcgtatctggagcgcgatcggggccaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtgggatgaatcggttgggcttccagcccgatcgcgtgcttaccgtctggcagcagttgcgggcaatggcgaatgttggcgaaatgaccctgatgtcgcattttgccgaagcggaacatcctgatggaatttccggcgcgatggcgcgtattgagcaggcggcggaggggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcagggtacgccgacggttatccgcgccacgcgcctaccggtacccctgttttagtggacggcgtgcgcaccatgacggtggggaccgtctcgatggatatgctagcggtcgatttaacgccttgcccgcaggcgggtattggtacgccggttgagctgtggggcaaggagatcaaaattgatgatgtcgccgccgctgccggaacggtgggctatgagttgatgtgcgcgctggcgctacgcgtcccggttgtgacggtgtaacttgttgtaagccggatcggaggcaacgtcttctgggtgcaaaaaaatcatccatccggctggtcagcaactgtagttgttaatgtgacagagccattgcccatgatagtgtccattaaaaggatggacactatttccccggaacctgaactcaccgcacaggcgttctacataaaacgcttacgcttcattgttgactcgaactcgacttcagataaatcacgctttacccttgatggagcctgtacatagatttgtgtaattgcctgattttgatatgttcaattcaacatcaaatgaaggttaaattatggacgacaaacaattgcaggctcaggctgcgttcagcaaagcatcgcaaccggcgatagatgcttcattaaatttaagattcagcttcctcttcagccacccgtacgccaatcttcaacacttcattatcttctttctcggccaccgtccagatcatcccggcaaactctacctggtcaccgacaaccggtgccgcgcctaacaactgctggacaatttcacccagcgtttgctgcttatcacgatattctcgcccgtcttccaggccatatatcagcgcaacatcagcatatttggcgctggcttcgagaatgaagtcaccaaagaagcgttgatccagcgcgaccggcggcgactggctgaacagtttaccgagcgccggaagatcgcgttcccgaccaattacacacaacacatcgccttcgcgcagtcgggtgctgccggtaggatgaagcaactggttatcacgaaacagtgccgcaatacgcgtctcttttggcatatgcaaatcgcgcagtgccgcgcccacgcaccatttatcggcactcaattgataaacaaactgctcccacggattttccggatgaatatccaggccaacgcgtgacaccggacgtcccactggcggaaccaccactttggcttttttagccgcccacgagagtgatgttccctgcaagagcagtgaaaccagaaccacaaagaaggcgacattaaagaacagacgtgcattctccagccccgccatcatcgggaacacggccaggatgattggcaccgcgccgcgtaatcctacccagctgataaacacgcgctcacgcagattgaaaccgcggaaggggagcaatccagcaaataccgaaaggggacgggcgaagaatatcatccatgcggacaaaatgagcgccggaatggcaataggcagcagatcgcttgggttaaccaacagccccagcaccaggaacatggcgatttgcgccagccaggcgaggccgtcgaaattttgcaggatgccgtagcggttgcgaatagggcgattacccagcagaaaaccgcacagatacaccgccagaataccgctaccttccagcgcagtagttaatgagaaaatcagaataccgccacttaatgccagcaatggatataatccggcgggcagggcgatgcggttgatcatttgcagtagtaaataaccgccgccaagacctattacaatgcccagaccaaattgttgcagaatatcgacaatgaacatccagctaatattgctctcatgatgctggatcatcgcaattagggtaatcgtcagaaagaccgccattggatcattactgccggattcaatttccagcgtcgagccaacacgttcgttaagccccttaccacccagcagagaaaagaccgctgcagcatcggtagagccgacgatagcgccgattaataagccttcaatcaaatcaagattaaacagccacgccgccatcatgccggttaaaccagaggtgataagcacgcccagcgtcgccagcgacagtgccggtcctaacgccacacgaaaggaactggcctgagtgcgcatcccgccgtcgagcaaaataatcgccagtgccaggttacttaccatgtaggcgaaggggtaattatcaaacgggataccgccgacgccatcgactcctgccagcatgccgatcgccagaaaaataaccagaataggaatgccaagacgggaagaaaatgaactaagtaatatactgctggtgacaaggatggatcctaagatgaaaaggctaattattgttgtggcatccaacggtcggttactcctgattacgctgtctcttatataaaccctaccatattagcggcagagacagcgttttacttagccctgaagcgtgatttttttacattttaagaacaggatgaccgctaatcgtcaactgagtgccttcccgggtgttattcagaatggcatgtgcgcccaacggcagcgtaaccgtgcgttgttcatgaccaaaatcgaggccggtaatgagtggaatcgacaggcgggaacgcaaaaacgcgtacactgactccaggttgtaacctgcgtcataatcattgggcgtgctgccgctaaagctaccgagaataatcgccttctgacgtggcaaaattcccgcatgatagagctgcaacagcatacgttcgacccggaaagggtgctcgttaatatcttccagcaccagaataccgttctcaatttttggcatccacggtgtaccgatcagtgaaatcagcatcgcaagattgcctccccacaacgtgccttcggcccgacatgtcgggccttccccttgccattcaatggtgaaggtttcattgcgtaacgccagccagaaatggtgctcggtaaaggcgttcagttcatccgcgccaaagtttgctaccagcatggggccgctaaaggtgatgacattgccatgcgccagaagaccgcactgaatggcggtaaaatcgctatgtccgcaaatgagcaacgggtcatgttgttggcgagccaccagtgcctgccagtcaatatctgccagtaaacgactggcaccgtaaccgccgcgtacagccagcacgatggtgttgggggtagtcagtctggcaagggaattgagatcttccagacgctctgtttccgtacccgcaaaacgctcacaacgacgggcaataacctcgacgttattgacttgatgccccgcgtcggtaaggcgctggataccacgcagcgcggcgtgctgtttaatgcagtaacccgatggggcaattaagtgaaacagagacatggcaattccttgctgacaacagaaacgaaatgtatatcatgccgcttaggtgtgccgttgtcacctcaacggcgattccaggctataaggatagaagaagtgaaattgagatggtttgcctttttgattgtgttattagcgggttgttcatcaaagcatgactatacgaacccgccgtggaacgcgaaagttccggtgcaacgtgcgatgcagtggatgccaataagccagaaagccggtgcagcctggggcgtcgatccacaattgatcacggcgattatcgctatcgaatcgggtggtaatccgaacgcggtgagtaaatcgaatgccattggtttgatgcagttaaaagcttcaacctccggacgtgatgtttatcgccgtatgggctggagtggtgagccgacgaccagcgagctgaaaaatccagagcgtaatatttcaatgggggcggcttacctgaatattctggaaaccggcccgctggcaggcattgaagatccgaaggtactgcaatatgcgctggtggtgtcatacgctaacggggcaggtgcgctgctacggactttctcgtcagatcggaaaaaggcgatcagcaaaatcaacgatttggatgctgacgagttcctcgaacacgtagcgcgaaatcaccctgcgccgcaggctccgcgctatatctacaaacttgagcaggcactggacgcgatgtaaatcagtcgcgcactttgtccgctttttcccgggcttctcgctcgagagagaaaataatccgctgtaattgccgctccaccgtcgggctgacgttaagaaaacggaagctcagacggggagtggtgatggtttcattcttgccatcaatcactttgcgctcgctgatggagattaactgggcgtcaaagtgaaaaacaccccattgccccatgttgacttcaatctgagcgaagcgcatgccttcttgtaattcggcaggctttgctgtttccagtaatgcgcccatgccgcctaacgacaaatcatacaggcggaaacgtaacgtactgttatccgccagtttggtctggcaaaaataaggcggatggagtggggcggagatgcggaaatatcggcgtcgttgtacaaaccataaggtgggaggcggtacggtaataaatgccggaagctgcaagtattcactctgctgtagttgttcaacagtaaactcgactttcgcaccctgagtttcggcggtaatggtaatgtgctgtgcctttagcacggcgatgttgtcttcggcttgactgccgaaatccagcaccagtttatccggggttattgccagtaatttgctgatcagctgcccgccattccaactgagacgcaaaggaattgcggctttgtgcaaatcgcgtaacacgcccaggacggctaacggattttgtttcaggaactgctcatggtaatgactcacgcggaaaaactcctgactgacaaactgtctttggtttatcggtcacagttaacaaaacttaatacaaatgcgtgaatattttttacatgttgttcttaaatcagccgacatacgcccagcatcgatcccgcccttgcctatacttagagcgttgatgtaagcatttcttgcgtccgattcatcgaaacgagggcctgaacatgggaattattgcctggattatttttgacctgatagccggcattatcgccaagctaatcatgccggggcgtgatggtggtggatttttcctgacctgtattctcgggatagtcggtgcggtggtcggcggctggctggcgaccatgtttggcattggcggctccatcagtggttttaatctgcacagcttcctggtggcggtggtgggagctattctcgttctgggcatattccgcctcctgcgaagagaataagattttcataaggcggatagcgatacagatgccgctatccgctttcacatcagaacgtatactcgacacctgctttacgggtgaaaaaaatcaatatagcacttcgatatccgataaagtcggttcccggtaacaacaacagaatccttttttaattattgtttcgttgtttttggtgtgattcagaaaataaatattttagacagtagccagtcaggcgttaaaaatggggcggatagtgaggcggttttggctgcgcttattgaacatttagaattgatcaatccttctggcagattaagccaaaatacccgttcggcaatgcttcagttacgcgaagaggaatggtctgaattctttttttggttgctaaattctctggagtgtctggattatgtgattattaatttaactccagaaagcaaaaaaacgttgatgagtgaacaccgtaacaatattcaggtagcaattgatgctttatatagccaacgtcggcgtaaatcgccgggtgatgaaagtgaaacacttacccgtagaaatgacgctatcttcggcaaccacgtatggcaaacatttgcgcaatacttcccgccaggacttgaaaaaccgtctgtgtagaaaaaaccatagctatggtgttatctgccgacaacgccatccggagaagccgaatgacgttgtcggagtaagcgctggttaaggtgtgggttgtgcctctttggttgagggttgcgtcgttgctgacttaacggtcggacgcgtcgccggaacattgtcacacggttgctctttcgggcagatcaaatccagcattttcagcgtcacgccattggtccagccaaagccatcctgtaatggatattcgccaccgccgccccccgttccggtggtgctgacatcatatttttccaccagctttttctcccggtcataggtgtgctgaacattggtcaggaagtgccagctaatgtccatcgccacctctttttgcccgtagttttgtaatccttctgtcgcgacccactgtaacggtgcccagccatttggcgcatcccattgttgcccacttttcaccgacgtggtgttcaggccgccgggttgcagcagatgtgttttcgtcgccgtcgccattttgttggcgcgatctttcgctgccgcattgacgtacagcgggaacagggcggccgcggttaactgattgcgcactttatgacttttcaggtcgtaatcggcataccagccttgttgatcgttccacaggtatttttcgatccctttttgacgggcatttgccagcgtttcgtactggtttgccatcgcgttatctccggcagctttgctggcgcgggcgaggattttttccattttaaacatcaggctgttcagatcgaccggtacgatgctggtggtgcgtaaggtatttaactgctgcgggttgtccatccagcgcgagctgaaatcccagccagacgcagcggcagagcgcaggtcgcggtaaatttcagtggcaggtcgattcggattgcttttggcggtggcaatatcttccacccatgactctggtcgtggcgtatcgcgatcgtcccagtagcggttgagaagggtaccatcctgaagtttgacaacgcgtttttcctgttgtccggcttgcaggttttcaacaccgtccatccagtaagcatattctttttgcatttgcggcaggtattgcttcaacgcggcatcgccttcatgctgcgccagtaactctaccatcagggcaaagaagggcggttgcgagcggcttaaatagtaactgcggttgccgttgggaatatgaccgtaagtgtctatttcatgagcaaaattggccaccatatccgcgactttatcccagtgaccgctttcggcaagtcctaacatggtgaagtaactgtcccagtaatatacctcgcgaaagcgtccgcccggcacgacataaggttccggcagcggtaacagagaatcccatttttcggtgttttcggtagaacgcgttaataccggccaaagtccgtcaatatgttcgcgcagtgactgcccctctggcggaacatatttctcgccttctttcggcagggtgaaattgacgttaacgaaatggcgcagatcaaatccgctctggttttgctgcatccgataatcagcaaggatcatcagcggatcgctgttcggcacggcatcggcaaaggttttttggtccggaaaaagtttggcgttttgcacatcattaaacagcggccctaataaaatatcaggcggctgtggtgttaccggtgtttcttctgcctgcaccgatagcgcagcgaaacacaaaaagatacaggctggaattaacgccattttttgcgggcgagaaggtgcgggggatttcatcaatcattctcctttggcgaaaccgaataaaacggtattcaagtatcagaaaaccttagttcaggatcgcactagctgcatgatcgaaatctcattctgcgaactgtcaggcattttagaaaagggaattaaagggataaataacggcgaaatagagtgatcaaataacgtctgtttattagccagccagcggcgttgggttcgtgattagcgaagaaaaatcatcataaattggtgaaaaatataacaggtagttaaaaaccattagtgctgagtaaattgccggatgacatcagaacgatgccatccgaacagtggcttaaccctgacggttgaaacgttgcgttttaacgtccagcgttagcgtttcttctggttgtatcgcatacagtttctcaccctgctggcaaatccagccaatccccagttcacgggcgattagggcgctgtgggataccggacttccggcgctaaggcagataccttttacaaccgccggatccagttgcagtactgtggaaggataaatgttctccgccagtagaatagttggcgagttaaactgcgggagttcttctttcgtttgggtcaggtggaccagggtgcgatgcagaagatcgtccacatcaatatagcgagcttgtagatattcatcatccagttgctggtattgctggctaagttctttaagaacttgctgccaggcatattctgccgtgcaatgttcatgctgaaggagttcgcttgccgccgccagcagttccggatcatctaacagtgtatggtgaccagaaaagattgcggcaatatcgtcaagcccgctggcttctgctttcgctgttaacgtcatcagatctaataacgtgaagtcaatagcctggcgtaatcgatcttgttcttcttccacggtcagggttgattttgcctgtaccgtacataaaactggttgataataaaaggctttacccgaaacaggcggaacgggacgcagagtaggtggagcgacttcctccgtttcaccaaagttatcttcagccagctgacggaaagcgatcagtgcctcttcagcttctggccctttcgcaatcaggcgcagcgtatcgttatagcgaacttgtagtaacgcaatctggttaatactctctggtgtgacgcatttgccgtttttttccagcaacatatcggcattaaatgtcgataaggtataaaccagccgggaggccggacgtacatgcaggccgttacggttttttatgaccaccgccagagaacgggcttcttcatcgtacgcaggacatgtgtcagagatttcagtgtcggaggacggtaaacccagttgttcacgtttggcttccagcgcatgcatggcgtcaaagataactttgtcgatatccgcccccgaggccgcgctgaccgttgctgccagtgtaccttcgaccaacggcgcagcacacaaacgtacttttgcggcgatctcgggagccagcaattccagcgcagtttcagcactcaataatgcgctacccatatccatcatgaccagcacatggtcggcatcagcaacagattcgatggcctccatcactttgacggcatcggtaccaatgggattttgtggatcgtcaattcccgcggcaatggcgattttacaactatcactcattaacatctgacgggctaattcaccgacaccttctcccagtcggctgctatgtgaaactatgaccaggtttaccatcaccaattccttactcttttgcggctaacgccaacatttgcatcataaacatcaccgaggtcgcgccgggatcctggtgaccaatactgcgttcaccgagataactggcgcggcctttgcgggcttgcatcgtaatcgtactttgtgcagcggattcggcgatgctactggcagcttcgagcgccaccggaacagagagattttgctcgctggactgacgtaacgattccaccaccggcacccacacatcacacatggttttatcgccaggttcggctttcccgcgactgattacgccgtccgcgccatcgcggaacatctgataaagctcttccagtgtcaggctttgccgtgcctgggtcgcctgtgcggcgcggataaagaaggtaccgaacagcggaccactggcaccaccgacgctggaaagcagcgtcataccggtattcttgagaatgaaaccgatatctttatctgcgatagcagggagtttttccaccactttgctaaagcctcggttcatatttagcccgtggtcagcatcgccaatttcgcgatccagtccggtaagatactcgctctcggtgctgaaaatatcgccacaacgagtgagccagttaacaatttgagttctgctcagtgacattgctttctccttatttaccccagttaagggccggggtgtggaccggggcgtcccagagtgccagcgtttcgtcatcaactttcagtaaggtgattgagaaaccggtcatatccagtgaggtgcagtacgcgccaattaaattacgttcgatagtcaatcccgcttgctggcaacgtgtggtcaggcggttatagacgccgtacagctcagaaagcggagttgcgccaagattgttaaccagcgcaatcacccgatcgccagactggagcggttgtttggtttgttgttcttcctgccaactgccttgttgataatcccagaaacgcaaagtgcgatggtatgagccatttaccagcagggtgtcgaacatttcatcgacggtttgatcaagggaagagaaggggcggcggtcaatacccggctcaccatgaatgccgacgccaaactccatctcattatccgccagggtaaaagaaggtttgcccgcggcaggaacggtacaggcaccgagagcgatacctattgagtggccttgattattcagcttacgccccagttccgcacaggcgtccagtgagtcgccacgctccgccgctgcgcctacgagtttttcaattaatacggtgttggcaacgccgcgtcgcccggcagtataaagactgtcttttaccgcaacgtcgtcatcaatgaccacagtggtcacttttacgccgctatcgtgcagtaactcggtcgctgtttcaaagttaagaatatcgccggtgtaatttttgataatcaacagtacaccttcgccgccatcaacttgcatggcgcattcaaagattttatcgggcgtcggtgaggtgaaaatttcgcccggacaggcccccgaaagcatcccctgaccgatataaccacagtgcatcggctcgtgtccgctgccgccacccgacagcagggcgacttttcctgcaacaggggcatcagctcgggtgacatacaccggatcctgatgcagtgtcagcgatggatgcgctttcgccagtcctgccagttgttcgtccagtacgtcttgcacatcattgatcaattttttcattattttgctccagcaattacggtagggcatggatgatgttcaacgacacggcgaccactgactgccgatgaatccattgtgcatcaggcaagggaaaagaaaattagcccaaattatgtttcatagtgaaacatatgctttaatgaatgttccatattgaaacttttacgtgtattaatacttaaaattgcgagccggaacaccttttgtcataagggatgcgggatatgagtggcgcttttaacaacgatggtcggggcatatctcccttaattgcaacctcctgggagcgatgcaataagctgatgaaacgggagacatggaacgtaccacatcaggcccagggcgtgacatttgcttctatttatcggcgtaagaaagcgatgctgacgctcgggcaggctgcgctggaagatgcctgggaatatatggcaccgcgagagtgtgcgctgtttatcctcgatgaaaccgcctgcattctcagccgtaatggcgatccgcaaaccttgcagcagctaagtgcactgggattcaatgacggcacgtattgcgccgagggaattattggtacttgtgcgctatcgttagcggctatctctggtcaggccgtgaaaacgatggccgatcaacatttcaaacaggtactctggaactgggccttttgtgcaacgccgttgtttgacagcaagggccgattgacgggaacaatagcgctggcgtgtccggttgagcaaactaccgcagctgatttgccgttgacgttggcaatcgcccgcgaggtcggaaatttactgctgacggacagtttgctcgctgaaactaaccgtcatttaaatcaacttaatgccctgttagaaagtatggatgatggcgtgattagctgggacgagcagggtaatttgcaatttattaatgcccaggcggcgcgggtcttgcgccttgacgcgacggcaagtcagggacgggcaatcactgaactcttaacgttacccgccgtattgcaacaagcaataaaacaggcacatccgctcaaacacgtagaagcaacctttgaaagccagcaccagtttattgatgcggtgataacccttaaaccgataatagaaacgcagggaaccagctttattttgttgctccatcctgtggaacagatgcggcagttgatgaccagtcaattaggaaaagtcagccataccttcgctcatatgccacaggacgatccgcaaacccgccgcttgattcattttggtcgccaggcggcgcgcagtagctttcctgtcctgctttgtggagaagagggcgtgggcaaggcactgctaagtcaggcaattcataatgaaagcgagcgtgctgcaggtccttatatcgccgtcaattgtgagttatatggtgatgctgcgctggcggaagaatttattggtggcgatcgcacggacaatgaaaatggccgtctgagtcggctggaactggcacacggcggcacgctgtttcttgaaaagattgaatatctggcggtggagttacagtctgctttgcttcaggttatcaagcagggggttatcacgcgactggatgcgcggcgtttaataccaattgatgtcaaagtgattgcaacaacgaccgcggacctcgcaatgctggtggaacaaaatcgttttagtcgccagctgtattacgcgctgcatgcatttgaaattaccatcccgcctctgcgtatgcggcgtggcagcattccggcgctggtgaataacaaattacgcagtcttgaaaaacgcttctctacgcggctgaaaattgatgacgatgccctcgctcgcctggtttcttgtgcatggccaggcaacgattttgaactttacagcgtcatcgagaatcttgctctgagtagtgataacgggcgcattcgcgtcagtgatttgccggaacatctgtttaccgagcaggcgacagatgatgtcagcgccacccgcctttccaccagtctgtcatttgcggaagttgaaaaagaggcaattattaacgcagcccaggtcacaggcggtcgcattcaggaaatgtcggctttacttgggatcggccgcactacgctgtggcggaaaatgaagcaacatggcattgatgcagggcagtttaagcgccgggtatgaaagacagaaacgatttctgatacatcagagtgatctgtatttcattccggcgcacgctaacaattttcagcatcgtttaagggcttgtctatcccgcacttaaaagctgaagcgatatcctccgttgacttgcttctgatcaaagaggttaccctgcgtgtaatccgcttcgagatagaatgtgtgctgtttgttatactgtgcactgactcccacgccgttattccagccattacctttgaaactgtacttctcccgggagttgttcaacagatattcggtatcccctgaaaactcgcggatagcgccagtcttcacatagacattcagctggctgttgcctgcggtgatgtcataccccagtatcatgctggcacgccccagcagcgattcgtagtgattcagatgtatattgaggccattactcgccttcatagtcatctcattctggtggctgtatgtaagctgggtttgcggctctatatagaacccataaccagtaggggacaggttgaacctctgcccggcttccagggagatgctcattccattcgcagtgccgttggcgttaacgccgttgttctgactgtccagtacgtggaaactatttttctggcgcgatgcttttataacgagatcgctgtaaaaaccgttttgtgccatgtaactggcgtacattcccatgtagtctgaacgtgcggtaccgtcgcctccgctatagtccggcgatgcatgtgttgagccaatatacagaccgacatacaacggcattacatcagagagacgtttatccccaccaaactggataccgctgtaacccatgtcaaagccgctcagtttgccactggcaaaggagtccaggcttcccccataactgcgcaaccagatattaccgtctttactctgatttcgcaggtcacccatccgttgcatcagcgtacggttttcaacatagttcaataagtaaccgacattgagataattgccgccagcatctgcggtcgtggtgggtttaggcgtgggagcgggttcaggcgtaggatcggggttgactatgggaggctgagcgggagctggtgtgggttcaggattaggagtcggttccggaactgtcccggaagcgtaaagctcccagttagtgccatttttacgcacatcgtacagatatccccccaactcaacctgagaagacgcgctgaacgaggccgcgccgtcagtggtttttaccactgtcagaacttcatttcccgttgtggcctcgctgccctggttgcggatagccaatacgtgattaccagcactactcccgctgatattcaataaatcccctttattattaacgccattaccctcgccaacaacatcagcacgcataataaaggtactgttaccgctcaggttctctacgtttaatgtggcaaatgtgccggcagttgacccgtggctggcaaaatcgacagttgaatggctcagcgccagcgtgtcgagattagaattacttgttacgttccagacgctgttattcattgcaacgtccagttttccgccattgacattatcgctgagggaggaacctgtccaaaccgacccagggtgcatatccagattgattagcccacctttggaaagaacgctaccgttgataagcatacgacccgaggcgttgatgcggctggcggcataaccatcgtcatgttgcgttgcgatggccatctggtcgggtgtactcatatcaatgaccagatcgctcgtgaggtcgatctggctgttggtcatggcataaattcccctggctcctgccgcgccggtgatagccaaactgtctccggttattctaccgccgctgagagcccacaaacccagcgccagactgccattacgatcaactgtaatatcggtattttgcatgttgacaacagccgttgccgtctgggccgaggcaccataagaaccgccggaaaagatgctgtttcgttgcgctgccgtgccagtaaaattgattatcgcgtctgaaccactggtgacgaggccaccgccctgcgcggaagaaatatggctatctgcaccgatagtggttgtaccaccacgaacttcgacgccattggccgcggctccagttacatcaacagtgagtgcattcgcgctaacctggccaaagctccagaggccgtgagcattatcgccattggttttaatggtactgtttgttccgagatcgacaacagagtttttctgtacgtttatccccatggcgctgtagccctgaacatcgattgtcaggtctgtagccgtaaaacgcgcagcaccattggcgttattgccgttgagaccaccgatataaacacctgtacttccatcggtcgtgattttacttccgcttccaagatcgacactggtgccatagtcattgatggttaggcctataccgttcgagttttcaatggtgaattgagtggctgttagtgttgagctatgcccaataatgatgccgtcatcgttactcttaatggtgctgcctgtgcctaagtcagcatgggtatagtcaccaattaagttaatgccgatggcagaggtttgaccaacaacatctactgtgagtcggttagctgtcagggagctgtttttgccctgaataatgattccttttgcatatccagaggcgtcgttgacattgacggtgacatcattacccaggttgatattgccaggcgtgtttcctgctggggtcattacaccatagaggtttcctgatggatcggcggtatctcctgtaattctgtcaccatcattaatagtaatattggtgccatattgacttcctgtatcagcagctatcagcaggggggaaaagataattgcattcaaaccaatagcgccaaattttatcagttgaattgagggcgaacggatttttaattcagcgagacgatctgctttggtattcccattgtgttgtttgatgcccataccactcctatatagtacccagactatgggtctatggattttgtcattttgtttaaatcaatgaataatatcctcttatcatcatgatatttgtatggtgcaatcatgatgagcttctcagagaataattctctattaccgggcaaaatcaggaacacaggaattaatatatatttaacatcccccttacaaaggtgagtttatatcgagttattccctaagttgtcgttacttattccaattcgttactataaatatggcaaaaatattacaacaaacagcggttaaaaaatttggtgaagattttttgtaataatcctaattagttatgggaatttcgcttgatgtatctgcataacaaaaacaatatgcgccatttttgcattactaataagaaaaagcaaaaaacatcgatattcatttttggtcaatgggttttctggcctatcgttgttattgtgctactggttatcattttcatcttgccagcatattggagcgtgatcaattttgatcagctgtgaagggggctgatgtgtagtgatacaaaaacttacgttatatcactgctaatgagatatccggcatctgaacacttatgtctttaattattctcgtggttcactataggcaataagcacaaaagtgtaggatgttacaagaatgattaggactcggtgaaatgaaaaatccacgcaattgcgtggattttatatacttttgcgctcttcatgagatttagcgaaacctcatgagacaataaattaattagacgttgaaaaggaagttcatcacatcgccatctttcacgatgtaatctttaccttctgcacgcattttgcctgcttctttcgcgccttgttcacctttgtaagtgatgaaatcttcaaacgagatggtttgtgcacggataaagcctttttcaaaatcagtatggattttgcccgctgcctgcggcgcggttgctccaaccggaatggtccatgcacgcacttctttcaccccagcggtgaagtaagtttgcaggttcagcagtttataaccggcacggatcacacggttcaggcccggctcttccagcccaagctcctgcataaactcgtcacgttcttcgtcgtccagttcggcaatgtctgcttcaacagcagcacaaaccggaaccacaacagaaccttctttcgccgcgatttcacgcacctggtcaagatatgggttgttttcaaaaccgtcttcgttgacgttggcgatgtacattgttggtttcagcgtcaggaagctcaggtaacgaatagccgctttctcttcagcgcttaaatccagcgcgcgcagcatacctgcattttccaactggggcaggcatttttccaggaccgccagctcagctttcgcgtctttatcgccacctttggctttcttctgtacgcgatgaatcgcacgttcgcaggtgtcgaggtctgccagcgccagttcggtgttgataacttcaatatcgtcagccgggttaactttgccggaaacgtgaatgatgttgtcattttcaaagcagcgaacaacgtgaccgatcgcttcggtttcacggatgttggtcaggaactggttacccagaccttcgcctttcgatgcgccttttaccagaccggcgatatcgacaaattccatggtcgtgggaagcgtacgctgcggttttacgatttcagccagttgatccaggcgaggatcaggcattggtacgacgcctgtgttcggctcaatggtgcagaatggaaagttggccgcttcaataccggctttggtcagcgcgttgaacagggtagatttcccgacgttgggcaaaccgacgataccgcatttgaatcccatgatttaaatcaccttaatatcttaataatcaacctgttattgctaacagattgcagaaatggaaataactttgcctattatacacggcactcggcaaaaatgccgcagacaacgacttattgcgctttaaaggcgtgcaatcggttcgttgctttggtcaagccatctgtaaaccacatttcagtacaacgcgccgcttcgtcaatggcttcatcaattaacttctgttcactaacaggcggtttgcctaacacaaaaccgacaactttatttttatcgcccggatgaccgattccgatgcgtaaacggtgaaagttagggttattacccaatttactgatgatgtctttcagtccattgtgaccaccatggccaccgcccaatttaaatttggcgacgccaggaggcagatccagttcgtcgtgggccaccagaatttcgtccggattaatgcggaaaaaactggccatcgccgcaacggctttgccgctgagattcataaatgtagtcgggactaacaggcggacatcttcgcctccaagagtgactcgcgaagtataaccaaagaatttagcctcttcgcgcagcggagcgcgcaaacgctctgccagtaagtcaacgaaccaggcaccagcattatgtcgcgttgcggcgtattcagcaccggggttcgccaggccgacaatcaatttaatcgtcacgtttttttgtcctgagtgtgtacataactggcgcgtagtttactggttgcggccccgcttgacaaaaaactgcgtatcaaatgcagataacgtaataattgcctgagtggactattagaaagtcaaggtgttcaggcgtttatttgtaaagttttgttgaaataagggttgtaattgtgatcacgcccgcacataacccactgggtgttgtctatactttacacataaggaagaggggtattccctgttacaacccagaaagttccggaggtgacatatgaaacgcaaaaacgcttcgttactcggtaacgtgctcatggggttgggtctggtggtaatggtggtcggcgtggggtattcaatcctcaaccagttaccacagtttaatatgccccagtatttcgcacatggtgcagtgctaagtattttcgtcggtgccattctctggctggcgggtgcccgtgttggcgggcatgaacaggtgtgcgaccgttactggtgggttcgccactatgacaaacgttgccgccgtagcgataatcgccgtcatagctaacaaataatgcagtttgctgaccagtcagtttgcgctgactggtcaatctcgtacttataaatccgccatcgccgcgcgacgattcgggaagaacgccaggcgtcccgggatcggttgaatgccagcgcgagccatagtgcgcagtggctggaattccacgttgcacacgcgcagttcacatccctcgggcagacgcttcacaaaacgctggaacgcatcaagaccaccagcatcaagtaccggaacggcatcccacttcagaatcacaatccgtttgccttcaagacgtgactccaggtccgtgaataagccttcagcagcagcaaaaaacagcgggccaataacgcgcagaaccaggacatcgtctggaacatctacgactaccggtgccaggcgagtcatacgtgcgatacgacgcataaacagcagcgatgccagcacgatccccacgctgatggcaataaccatatcaaacaacacggtcagcgacatgcacagcagcatgacgatgatgtcatctttcggcgcatgacgcagcaagtcgaccactttgtgcgcttcactcatgttccacgccaccatcaacagcagggctgccatggcggaaagcggcagccaggagagcagcggtgccagtaccagcagggcaagaataaccagaatagagtggatcaccgccgagataggggacgttgccccggcacggacgttagcggcagaacgcgcgatggcagctgtagcggtaataccaccaaagaacggagcgataatattccccagtccctgtccaaccagttcgctgttcgccttgtgtttcgtcccggtcataccatccagcaccacggcgcagagcagagattcgattgcgccgagcattgccattgagaatgccgcaggcagcagtgtgcgaatagaatcccaggttagcgtgaattctgaattaggcagatcccacggcagcaccagttgcggcagcagttgcggaataccgttaccctgagaaccatcggccaggacgtagtggaattgcgaaccgatggtagcaacatgtccgccgagcaggttaacaatccccatcaccgcgcaaccagccagcaaggccggaaggtgaccgggtaaacgaatgcccagacgcggccaaaaaacaagaatacctagcgtcacaatgccaatggcagcatcacccacattaatggtcggcagcgccataaataatgcgccgactttttgtagataatgttccgggacatgggccatttgcagaccgagaaaatctttaatctgcatggtaccgatggtgatcccgatacccgaggtgaaacctaaggtgacggaaaccggaatatactcaatcaggcgaccaaagcgtgccagacccatcagaatcaaaaagatccccgacagcaaggtcgcaaccagcagtcctgccagtccaaactgttgcgacacgggatagagaattaccacaaatgccgcagtcggaccggaaacgctaaagcgtgacccacccgtcagagcaatgacaatccccgcaacagctgcggtatataaaccgtactggggtgccacaccactaccaatagccaacgccatcgccagcgggatagcaataatcccgacggttatcccggcaatcaggtcacgggtaaaccgtgcggcagtatatttttctttccagcaagcgtcgatcagagcgcggaaaggcatcacatgtgaggaaaatattttgttcacaataatgtttcatccgtgagcgcatcatctgtcaactaaatggcaggtgaaggaggcataggtcatacaaatggatattacagacaaaaaaacccgccgcagcgggtctttgagccgggttcgattagtgttcgaacatggcagagatcgattcttcgttgctgatacgacgaatcgcttcggccagcatacctgacagggtcagagtacgcacgttcggcagtgatttgatttcatcgctcagcggaatggtatcgcagacaacgacttcatcaattacagagttacgcaggttgttcgccgcgttgccagagaagatcgggtgagtcgcgtacgcaaatacacgtttagcaccacgttctttcagagcttcagcagctttacacagcgtaccgccagtgtcgatcatatcatcgaccagtacgcagtcacgacctgcaacgtcaccgatgatatgcatcacctgtgaaacgttcgcacgcggacgacgtttgtcgatgattgccatatcggtatcgttcagcagcttagcgatagcgcgggcacgcacaacgccgccgatgtccggagaaaccacaattgggttatccagattcagctgcagcatgtcttccagcaggatcgggctaccaaatacgttatcaaccggaacgtcgaagaaaccctgaatctgttcagcgtgcagatccactgtcagcacacggtcaacaccgacgctggagaggaagtctgcaaccactttcgcagtgattggtacacgagcggaacggacgcgacggtcctggcgcgcatagccaaagtaggggataacagcggtgatacgacctgcggaagcacgacgcagggcatcaaccataacgactaattccatcaggttgtcgttagtaggggcacaagtggactggatgatgaaaatatcaccaccgcgtacattttcattaatttgtacgctgacttcgccatcgctaaagcgacctacagcggcgtcgccgagtgaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcatgatcctttccaggcggtgtattaaagagcgcgatgcaacgtctggaacaaggtgacgttgtcaccgaaactcagcttgcccggcttaaagcatggctctgtgcaatggggaaagattagcgcctttcgccacaaagccattgagccattccggggcttgctctagcacctggcgggcttcagactctgtatcaaattcagcaaagacacaggcccctgtcccagtcaggcgcgacggggcgtattctaacagccaggaaagcaccgcatcaacctcgcgaaaacgttttcttgcgataacctcgcaatcattgctgaattcacattttagcaacgtttctattgacctttttggcgtattgcgcgggagttcaggatctttaaaaatcaccggagtcggaatacttacaccagggtgcgccaccagataccacttctctggcggatccaccggcgttagtatttcaccaacgccttcggcaaacgcggcatgcccccgaacaaagacaggaacatctgcgcccagcgtcagccccatttccgccagctcatccatgcttagcccgcattgccagagatgatttaatgccaccaggaccgtcgcggcattggatgaaccaccgccgagaccgccgcccatcggcaaacgcttgtcaatgctgatattcgcaccgcttcccgtcggaagacgcccgctgtctgccgcagttttcatcaacaatcgcgctgcgcgaacgatcaggttatcttcatgttccacgccttcaacgggcgttaacagacgaatatccccatcgtcacgaagctcaatgctgatggtgtcgccgtaatcaagaaactgaaacagcgtttgcagcgtgtggtaaccatccgcacgctgaccggtaatgtataaaaacagattaagttttgccggagagggccactgtgtccgcattatttcactatccagttatccatttttaacttgatgcgttgaccaccgtcggtgagttccatattggctggcatcgcaggttgcgttttggtgtcataaccaccataaacaaccttccagtttttgccattctggctgtaggtaatttcgctcaggcggtactggtcgtccagtttgtagtcggttgcatcacccggtaaacctaaaatccactggcgcaagctgttgagcggaattggcattccggtcaatttgccaatcatctcttcggcgtcatcggcggtataacgctgacctttattgtcgactaactgcacgttacccggttgagcattcagctccagttccgtgctgcccaatgggttagtgagcagcagacggtagcgatcctggccggtttgctgccagaaaaagcgggcgtacactttttgttggtcagaaatataagcgaacgcgccgcgagtctgatactgattaagattgcgcacgtcttgctgatgctgacgccattgtggcgaatccgggcttttgccaggacctttgggcgtggtaacggaacaggcagtgagcacaagagcagccagcggtagcaggcggataagacgaaaatcgggcaggggcatagtgatgacaagtccttgagatacgttgcagttataacccttaatgctagcgttaccgtccgctatcgtctatgttcaagttgtcttaattgccagaatctaacggctttcggcaattactccaaaagggggcgctctcttttattgatcttacgcatcctgtatgatgcaagcagactaaccctatcaacgttggtattatttcccgcagacatgacccttttagcactcggtatcaaccataaaacggcacctgtatcgctgcgagaacgtgtatcgttttcgccggataagctcgatcaggcgcttgacagcctgcttgcgcagccgatggtgcagggcggcgtggtgctgtcgacgtgcaaccgcacggaactttatcttagcgttgaagagcaggacaacctgcaagaggcgttaatccgctggctttgcgattatcacaatcttaatgaagaagatctgcgtaaaagcctctactggcatcaggataacgacgcggttagccatttaatgcgtgttgccagcggcctggattcactggttctgggggagccgcagatcctcggtcaggttaaaaaagcgtttgccgattcgcaaaaaggtcatatgaaggccagcgaactggaacgcatgttccagaaatctttctctgtcgcgaaacgcgttcgcactgaaacagatatcggtgccagcgctgtgtctgtcgcttttgcggcttgtacgctggcgcggcagatctttgaatcgctctctacggtcacagtgttgctggtaggcgcgggcgaaactatcgagctggtggcgcgtcatctgcgcgaacacaaagtacagaagatgattatcgccaaccgcactcgcgaacgtgcccaaattctggcagatgaagtcggcgcggaagtgattgccctgagtgatatcgacgaacgtctgcgcgaagccgatatcatcatcagttccaccgccagcccgttaccgattatcgggaaaggcatggtggagcgcgcattaaaaagccgtcgcaaccaaccaatgctgttggtggatattgccgttccgcgcgatgttgagccggaagttggcaaactggcgaatgcttatctttatagcgttgatgatctgcaaagcatcatttcgcacaacctggcgcagcgtaaagccgcagcggttgaggcggaaactattgtcgctcaggaaaccagcgaatttatggcgtggctgcgagcacaaagcgccagcgaaaccattcgcgagtatcgcagccaggcagagcaagttcgcgatgagttaaccgccaaagcgttagcggcccttgagcagggcggcgacgcgcaagccattatgcaggatctggcatggaaactgactaaccgcttgatccatgcgccaacgaaatcacttcaacaggccgcccgtgacggggataacgaacgcctgaatattctgcgcgacagcctcgggctggagtagcagtacatcattttctttttttacagggtgcatttacgcctatgaagccttctatcgttgccaaactggaagccctgcatgaacgccatgaagaagttcaggcgttgctgggtgacgcgcaaactatcgccgaccaggaacgttttcgcgcattatcacgcgaatatgcgcagttaagtgatgtttcgcgctgttttaccgactggcaacaggttcaggaagatatcgaaaccgcacagatgatgctcgatgatcctgaaatgcgtgagatggcgcaggatgaactgcgcgaagctaaagaaaaaagcgagcaactggaacagcaattacaggttctgttactgccaaaagatcctgatgacgaacgtaacgccttcctcgaagtccgagccggaaccggcggcgacgaagcggcgctgttcgcgggcgatctgttccgtatgtacagccgttatgccgaagcccgccgctggcgggtagaaatcatgagcgccagcgagggtgaacatggtggttataaagagatcatcgccaaaattagcggtgatggtgtgtatggtcgtctgaaatttgaatccggcggtcatcgcgtgcaacgtgttcctgctacggaatcgcagggtcgtattcatacttctgcttgtaccgttgcggtaatgccagaactgcctgacgcagaactgccggacatcaacccagcagatttacgcattgatactttccgctcgtcaggggcgggtggtcagcacgttaacaccaccgattcggcaattcgtattactcacttgccgaccgggattgttgttgaatgtcaggacgaacgttcacaacataaaaacaaagctaaagcactttctgttctcggtgctcgcatccacgctgctgaaatggcaaaacgccaacaggccgaagcgtctacccgtcgtaacctgctggggagtggcgatcgcagcgaccgtaaccgtacttacaacttcccgcaggggcgcgttaccgatcaccgcatcaacctgacgctctaccgcctggatgaagtgatggaaggtaagctggatatgctgattgaaccgattatccaggaacatcaggccgaccaactggcggcgttgtccgagcaggaataatggaatatcaacactggttacgtgaagcaataagccaacttcaggcgagcgaaagcccgcggcgtgatgctgaaatcctgctggagcatgttaccggcagagggcgtacttttattctcgcctttggtgaaacgcagctgactgacgaacaatgtcagcaacttgatgcgctactgacacgtcgtcgcgatggtgaacccattgctcatttaaccggggtgcgagaattctggtcgttgccgttatttgtttcgccagcgaccttaattccgcgcccggatacggagtgtctggtggagcaggcactggcgcggttgcctgaacaaccttgccgtattctcgatctcgggacgggtaccggggcgattgcgcttgcgctggctagcgagcgcccggactgcgaaattatcgctgtagatcgtatgcctgatgctgtctccctggcacaacgtaatgcccagcatctggcgatcaaaaatatccacattctgcaaagcgactggtttagcgcgctagccgggcagcagtttgcgatgattgtcagcaatccgccgtatattgacgagcaggaccctcatcttcaacaaggcgatgtccgctttgagccgctcactgcgctggttgcggcagacagtggaatggcagacatcgtgcatatcatcgaacagtcgcgtaacgcgctggtatccggcggctttctgcttctggaacatggctggcagcagggcgaagcggtgcgacaagcatttatcctcgcggggtatcatgacgtcgaaacctgccgtgactatggtgataacgagcgcgtaacgctcggccgctattatcaatgacaagtttttctacactgcttagtgttcatcttattagtatcgcgctttctgttgggctattaaccttacgtttctggctacgttatcagaagcatccacaggcatttgctcgctggacgcgcattgtgccgccggttgtcgatacgctgttactgttaagcggcattgcgttgatggctaaagcgcacatcctgccattttccgggcaggcacagtggctgactgaaaagctgtttggagttatcatttatatcgttttgggttttattgcactcgattatcgtcgtatgcacagtcagcaggcgcgcattattgccttcccgctggcgttggtggtgctgtacatcatcattaaactcgccaccacaaaagtaccgttactggggtaagtcatgagatcgttagctgatttcgaatttaataaagcgccattgtgcgaaggcatgatcctggcttgcgaagcaatccgccgcgattttccctcgcaagatgtttacgacgaactggagcgtctcgttagtctggcgaaggaagaaatcagccagcttctgcctttagaagagcagttggaaaaactgatcgcgctgttttacggcgactggggatttaaagcctcacgcggtgtttatcgtctttccgatgcattatggctggaccaggtgttaaagaatcgacagggcagtgcggtatcattaggtgcggttttattatgggtcgcgaatcgtctcgatttgccgctgctgccggtgattttccctacgcagctgatattgcgcattgaatgtccggatggcgaaatttggctgattaatccttttaacggtgaatcgttaagcgaacatatgctggacgtatggttaaagggaaatatcagcccgtcggcggaactgttttatgaagaccttgatgaagctgataacattgaggtaatccgcaaattgctggatacactcaaagcctcgttgatggaagaaaatcagatggagctggcgttacgcaccagcgaagctttattacaattcaaccctgaagatccctatgaaattcgcgatcgcgggttgatttatgcgcaactggattgcgaacacgttgcgttgaacgatttaagttatttcgttgaacagtgtccggaagacccgatcagcgaaatgatccgtgcgcaaataaataacatcgcgcataaacatattgtgctgcattaattaatcgacattttactcaagattaaggcgatcctatgaaacaaaaagtggttagcattggcgacatcaacgtagcaaatgacctgccgttcgtactgtttggcggtatgaacgtgttggaatctcgcgatctggcgatgcgcatttgcgagcactacgtaactgtgacccagaaactgggtatcccttacgtgttcaaagcctcttttgacaaagccaaccgctcctccatccactcttatcgtggaccgggcctggaagaagggatgaaaatcttccaggagttgaagcagacttttggcgtgaaaattatcaccgacgttcacgaaccaagtcaggcacagcccgttgctgatgtcgtggatgtgattcagttgccggcgtttcttgctcgccagactgacctggttgaagccatggcgaaaaccggtgcggtaattaacgtcaagaaaccacagtttgtcagcccgggacagatgggtaatatcgttgataaattcaaagaaggcggcaacgaaaaagtgattctttgcgatcgcggtgctaacttcggctatgacaacctggttgtcgatatgctgggcttcagcattatgaagaaagtgtctggtaactcgccggtgattttcgacgtgacccacgcactgcaatgccgcgatccgtttggcgcagcttccggtggtcgtcgtgctcaggtggctgagctggcacgagccggtatggcggtaggtctggcggggctgtttattgaagcgcatccggatccggaacatgcgaaatgtgatggtccatccgcgctgccgctggctaaactggaaccgttcctcaagcagatgaaagcgattgatgatctggtgaaaggtttcgaagaactggataccagcaagtaatcttttttgcttgaaaaataaagtattagcgttctgcgttaagacttttttcatgggtgccggatacaaaaaaggccgcaggctgttacccctgcggccggtttcgggcgcatattgccatcacggcagcctgacgcccgttttcaccttacttccggttacgccaccagctgacaatcgctgcggtaataattcccgccaggatcggtgctgccaggtcgtgccagaaaatcatggcaaactgcgcgagcgtcatatagccgccttgttgtaatgacaacattttgcggctattcttgaattgttctggttcaagattagcccccgttctgttgtcaggttgtacctctcaacgtgcgggggttttctctttccagcaaccaatgccaccagggataaagcccccgcaacattgcgcctcaccggataacgccggcttggtgtggatactacgactcaattcatcttcacttcatccctgaaatgtttgcaatgaagagtgcattccggtttttcaacagctgttacagtcatttcatgagtgctctggatgaggcttccagctcgggttgccaatatttacttgtggaagtgataaagacaaaaatggccgcaggctgttacccctgcggccggtttcgggcgcatattgccatcacggcagcctgacgcccgttttcaccttacttccggttacgccaccagccgacaatcgctgcggtaataattcccgccaggatcggtgccgccaggtcgtgccagaaagtcatggcaaactgcgcgagcgtcatatagccgccttgttgtaatgacaacattttgcggctattcttgaagtgtctggtttcaagattagcccccgttctgttgtcaggttttacctctcaacgtgcgggggttttctctttccagcaaccaatgccaccagggataaagcccccgcaacattgcgcctcaccggataattccggcttggtgtggatactacgtctcaattcatcttcacttcatccctgaaatgtttgcaataaagagtacattccggcttttcaacagctgttgcagtcgtttcatgagtgctctggatgatgcttccagctcgggttgccaatatttacttgtggaagagataaagacaaaaatggccgcaggctgttacccctgcggccggtttcgggcgcatattgccatcacggcagcctgacgcccgttttcaccttacttccggttacgccaccagctgacaatcgctgcggtaataattcccgccaggatcggtgctgccaggtcgtgccagaaaatcatggcaaactgcgcgagcgtcatatagccgccttgttgtaatgacaacattttgcggctattcttgaagtgtctggtttcaagattagcccccgttttgttgtcaggttttacctctcaacgtgcgggggttttctctttccagcaaccaatgccaccagggataaagccccgcaacattgcgcctcaccggataacgccggcttggtgtggatactacgtcgcaattcatcttcacttcatccctgaaatgtttgcaatgaagagtacattccggcttttcaacagctgttgcagtggtttcgtgcagggtgtggtacaggctcgcaattctgattaacgacctgtccaggtagtatgaagaaatacaataagcaggaatttatattatctcccccgattaccgtcatcggaggagatataactgtcaggcaaatatcgtcatcaaataggcggcaaacagtgccagatgcgctgcgccattgagcacgttagtacgtccggtggagaaggagatatggcacagcactaaagaggccaccatcaccaccatttctggcgcaccaagtgcaaactgcaattcgttacccgtcataaaggcaattagcgtgacgacaggtacggtaagcgaaatggttgctaacactgaaccaaagaacagattcatcgcgcgctgaacctggttgttcaacactgcttttaatgcacctaaaccttccggcgacagaatcaacagtgccaccaggaagccagtaaaggcgacaggggcattcatgctgtcgagcaatgtctccagcgagctggcgttcattttggtcaccgcaataacggcaatcagatggataatcaaccagatagcatgccacaggctgctatgggcagacggtttaccgtgatgcgggtcgtcatcatcactgtcatcttcgtgctcgtagacaaacaaactttgatgcgttttggtctggatcagcaaaaatacgccatacattgccgcagaaattaatgctaccagtaacgcctgaccggttgaaaaattcgccgcaggcagagccattggaaataccagtacgattatcgccagggggaacagcgcaattaaatactgcttgataccaaacagattcatatattgggtggcaaacttacgaccgcccaacaataatgaaaagccaaccagcccaccggtaacaatcataatgattgaatagagcgtatcacgcattagcgttggcgcggcgtcgccggttgccattaaagctgaaatcaaactgacttcaagaataaccactgaaaggctaagaataagcgaaccgtaaggttctcccaggcgatgggctaatacgtccgcatgacggacaacactaaaggcgctacttaaaataccaataagcgcaagaagattgatggcaatgaccactggtagtgtctggctgcttccccacaggaacagcactaccagcgccagaaccgggaaaataagcgaagtctccttgtggcgggtttttaccgcctcttgagcatttgacattatggttatccctttgcagatgaatttatcgaaaatgtaaaaaataggtaggaaaaataacagaaagtgtctggatatcggtaacattttacgaatttttaccccgctgtcgattttttactcattggggcataaaaataagtattacgtttagacaatgtttgttttagcgtctcttaagaagagtctgacctgaaaattcttatgttttggcaagagtagatattgttgaccacacttaatgttcaactttgtaaaaggagtcaacgatgccgtataaaacgaaaagcgatctgccggaaagcgtaaagcacgttctaccgtctcatgcccaggatatctataaagaagcgttcaacagcgcatgggatcaatataaagataaagaagatcggcgtgatgacgccagtcgcgaagaaaccgcgcataaagtggcctgggctgctgtgaagcatgaatatgccaaaggggatgatgataaatggcataaaaaatcgtaaaaccggtcgcttagttaaagctattcgtgcggtgttgccttgcaagtggtccgtggattgcatattgtcccgttagtggtttcaaaatgagcagtaaaaatgtccggaagacaccaaaaagttgtcgcagggaagtatgcagtggcggaagtgtaaggtgataacgcgtgatttcttgatgaatgccgattgtaaaacggcatttggtgccattgaagaatcactcttatggtcagcagaacaacgggcggcttcgctggcggcgacgctggcttgtcgacctgatgagggaccggtgtggatcttcggctatggatcgttgatgtggaatccggcactggagtttaccgaatcgtgcaccggtacactggttggatggcatcgcgcattttgcctgcgcctgaccgccgggcgcgggactgcgcaccagccgggacggatgcttgcactgaaagagggcggacgcaccacaggcgtcgcctatcgactgccagaagagacgctggagcaggaactaaccctgttgtggaagcgagagatgattaccggctgttatctgccaacctggtgtcagcttgatcttgatgatggacgcacagtaaacgccattgtgtttattatggacccgcgacatccagaatatgaatctgatactcgcgctcaggtcatcgcgccgttgattgcggcggcgagcggtccgctgggaaccaacgcacaatacctgttttcactggaacaggagcttatcaaactgggaatgcaggacgatgggctgaatgatttgctggtatcggtaaaaaaactgctggcggagaattttccggatggtgtgttacgtccgggattcgcctgagtaaacttcccgcatagtggggcgtcagacgccccctcaaacattaaaatgtgagcactttatcggctgacagcgtccattgcgccagttccacaagagtaccgatttccaccccatcaatcagaggaagtgtactaatcccgcgcccgtcggtacaggttttgcacaatttcaccggtacattctgagcggtaaggatctccagcatttgctgaatgttgtagccttcccctggtttttgcccgcgcaacccggctgtgaccgcatcagacatgaggaacagacgcagatccagattgctctcctgctctcgtaacgcaatggccagccgcaagctgttaaacaaggattcgctcccgtaaggtgcgccattggcaacgatcacgattttttgcattatttactcctgtattcagggaattagacactcatcttctatcttactgcttctgcagcgtctgaccaatcggtcacatttttaaggattttcctgaaagcgcgagaaaatacgacaaaagttgccagtaatcgttattctttaaggctatggtttttcattattaccggaagttaccgacgttttgagccgtttcgttcctcgcattatcccgttttatttactcttgcttgtagcaggcggtacagctaacgcacaatctaccttcgagcaaaaagcggcaaatccctttgataataacaatgatggtctgccggatttaggcatggctcccgaaaatcatgatggggaaaaacactttgctgaaattgtgaaagatttcggcgaaaccagtatgaatgataacgggctggatactggcgagcaggcaaaagctttcgcattgggaaaagtccgcgacgcgcttagtcaacaggttaatcagcacgtagagtcctggctatcaccgtggggaaatgccagtgttgacgtcaaagtggataacgaaggacatttcaccggcagtcgtggaagctggtttgtgccgttacaagataatgatcgttatctcacctggagccagcttggtcttactcagcaggataatgggttggtgagcaatgtgggcgttgggcaacgctgggcgcgcggcaactggctggtgggttataacactttttatgacaacttgctggacgaaaatcttcagcgagcgggctttggtgccgaagcgtggggcgaatatttgcgattatcggcaaacttttatcagccgtttgctgcatggcatgaacagacagccacgcaggaacaacggatggcgcgcgggtacgacctgacagctcggatgcgcatgccgttctatcaacacctcaataccagtgtcagcctagaacagtattttggtgatcgtgttgatttgtttaactctggtacgggttatcacaatcccgtcgcgttgagtctgggattaaattacacccctgtgccattagtcactgtgacggcccagcataaacagggtgaaagtggcgaaaatcaaaataacctcgggctgaatcttaattaccgctttggtgtaccgctcaaaaaacaactttctgcgggcgaggttgccgaaagtcagtcgttacgtggtagtcgctatgacaatccgcagcgaaataatctaccgactcttgagtaccgacagcgaaaaacgttaacggtgtttctggcgacaccgccgtgggatctaaaacctggcgaaacagtgccgctgaaattacaaatccgcagtcgttacggtattcggcaactgatttggcagggcgatacgcagatattaagtttgacgccgggcgcacaagccaacagcgcggagggctggacgctgatcatgcctgactggcagaacggggaaggggcaagcaatcactggcgattgtctgtggtggtggaagataaccaggggcagcgtgtctcctccaatgagatcacgctaacgcttgtcgaaccgttcgatgcattgtcaaacgacgaactgcgctgggaaccgtaatcagaaaatgcgctcctgatgcacccataccgctgcttccacgcgagacttgagcttcattttcttcagcatgtgcttgacgtgcacttttactgtgctttcggtgatatccaggcggcgggcaatcatcttgttcggcaaaccctgggcaatcagcttgagaatatcgcgctcgcgtggggttaactggttaacatcgcgctcagtagtggcacggttagcgcgcaagctggcggccagaacaggcgttaatgcttcgcttaataccatttcgccagcagctgcctgatgcaatgctttcagcagatcttccggttccatatcttttaacagatagccatccgcgccgcgtttcagtgcggtgaccacatcttcttcatggttagagacgctgaataccacaatgcgccctgagagggacttttcgcgcagtttatccagcgtttccagaccgttcatgccgggcatattgagatctaacaggatcagatcgggatcaagagactccgccagttcaataccctgttcgccattactcgcttcgccaaccacggtgatatctggtgccatactgataagctgttttacgccagttcgcagcatcgggtgatcgtcaatcagcaggatagtagccggttcctgattactcatgggtatctccttggacgtctgtgaaagttttttcgggaataaaggtgaccaccacttcggtgccacctgattcacgacggcggacgcggcaatcgcctcgtaaactttgcgcacgatcgcgcattattatcatgccgtagtgattgctgcggatggcattttcaggcacgccgcagccgttatcctggacggtcagtttgacctgattatcgttttgcgccaccgtcaccacgacttcactcgcttgcgaatgtttgagggcgttacttaatgcctcacgggcaatttgcaacaagtggattgcctgatgcgaaggcaccaggcgaggcggcaattgataatccagcttcaccgggaagccaaatttggcgctgtactcttcgcaactcgcctccagcgccggacgtaatccaggctcggtgagctgcaagcggaatgtggtgagcaattcacgcaactgcgcccaggatgcattcagttcgttacggatctgacttaacagttcgcggctgctttctggcagcgcatcgccctgcatctgtaaacaactcacctgcatcttcatgcaagagagagattgggcaatagaatcatgcagttcgcgcgcaatggtggcacgctcttccatcacgatcaactgttgctgacgttcctgatggcgatccagcgccagcgtggcggtgagttgttcaaccagggtatccaccagttgttgttgatcatggctaagatgacgcccctgcggcagggtcgccagcaaaataccgtactgcgtatgagagtcagccagccgccacttcagggtcgtgccgcgatcaccaacgggtaatacgccgcgcgggcagagctggcagcctttatcatcacaagtcatatctggctggcaggtaaactcctgatgattctcttcatcatcagtgtcatacacccgcaattcgatatcacgtagcagggttaaattctgtaagccgttgagtacaggtgacaggcgttcacacagcggggcgcgggaatgcaaacggcggttagcctgccataaaaaagagaggatctgatttttatgctccagcccggcggttttctcctgaacccgctgctcaagtacggcataactttcggccagttctgcagacatattgttcaacgcagttccaagcatcgccatttcgttgcgcccgctgatgtttgcgcgttgggtaaaatcgcgatgactgacggcactcgccattgccagcagttgccgccacggttgtagcagtcgcgcccgcaaccagataatagtgaacaccagtaaaagtgccataaataccgccattacccgatggaccagtaccactgtctcgatgcgcatttccgtggtgcggtcaaaaccagataccagttgatcaagcccggcaacaaactggctgacatccgctgacaccgtttctcggttttgtgcacgcatcagcgcagggatcagttcattacgccagtaatcttgtaaaccctgtaattgcgccagttgtccgtctcgttctgctgctcgagtcaactcggcgctaaatgccgtttgttccatctctttaattaagggcttgtctttctcgcttaatggcactgccgccaacagacggtaactttgcatgcgcagcgatcccgctttgttgatcgcatgggcgctgccctgaacgccttgcaccagccagccagaaaccgccatccctgccagtccaatagcagtagaaagcaacacaataagcgcaacctgattaaccagggtgagcggagagagacaacgtttaagcatgtaaacctcttccttcaggctttaaatgagcaataaccttaatgaatgtgacgatacattctggaatggcagtattctcggctattggctgaagtatacccatacccggaaagagttactccttatttgccgtgtggttagtcgctttacatcggtaagggtagggattttacagcaccgtgaaaaatctcataatttttatgaagtcactgtactcactatgggtaatgataaatatcaatgatagataaagttatcttatcgtttgatttacatcaaattgcctttagctacagacactaaggtggcagacatcgaaacgagtatcagaggtgtctatgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacctaccgaaagtcggctttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatctctctgctatgcggctttgctggcgcgaacttcgcatccagtatggcaaacatcagcttcttctttccgaaacagaagcagggtggcgcgctgggtctgaatggtggtctgggaaacatgggcgtcagcgtcatgcagttggttgctccgctggtggtatcactgtcgattttcgcagtatttggtagccagggcgtcaaacagccggatgggactgagctgtatctggcgaatgcgtcctggatatgggtgccgttccttgccatcttcaccattgcggcgtggtttggcatgaacgatcttgctacctcgaaagcctccatcaaggagcagttgccggtactcaaacggggtcatctgtggattatgagcctgctgtatctggcaaccttcggctccttcatcggcttctccgcgggctttgcaatgctgtcaaaaacgcagttcccggatgttcagattctgcaatacgctttcttcgggccgtttattggtgcgctggcgcgttctgcaggtggtgcattatctgaccgtctgggcggaactcgtgtcacgctggtgaactttattctgatggcgattttcagcggcctgctgttcctgaccttaccgactgacgggcagggcggaagcttcatggcgttcttcgcggtcttcctggcgctgttcctgacagctgggctgggtagtggttccactttccagatgatttcagtgatcttccgtaaactgacaatggatcgcgtgaaagcagaagggggttctgacgaacgtgcgatgcgtgaagcggcaaccgacacggcggcggcgctgggtttcatctctgcgattggcgcgattggtggcttctttatcccgaaagcgtttggtagctcgctggcattaacgggttcgccagtcggcgcaatgaaggtatttttgattttctatatcgcctgcgtagtgattacctgggcggtatatggtcggcattctaaaaaataaaccgttactcgtcatacttcgggttacatgtgctgcggctgcgttcattcaccccagtcacttactttagtaagctcctgggattcattcacttgccgccttcctgtaaaccgaattatatagagtaaaatatttgattatcctttgcgcggcatgatgtcgcgctttttttatgcgtcatttagttacaacatactaatgttatatggtttatttcgccggatttcattaagagccattaatatgttacccatggggaatactccttaatacccatctgcataaaaatcttaatagtttaaataactacaggtataaaacgtcttaatttacagtctgttatgtggtggctgttaattatcctaaaggggtatcttaggaatttactttatttttcatccccatcactcttgatcgttatcaattcccacgctgtttcagagcgttaccttgcccttaaacattagcaatgtcgatttatcagagggccgacaggctcccacaggagaaaaccgatgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgtacccgtccggatctgccaaaccatgaacctcgcggctgcccgcgcggtgccagctactcctggtatctttacagtgccaaccgcctgaaatacccgatgatgcgcaaacgcctgatgaaaatgtggcgtgaagcgaaggcgctgcatagcgatccggttgaggcatgggcttctatcattgaagacgccgataaagcgaaaagctttaagcaggcgcgtggacgcggtggatttgttcgttcttcctggcaggaggtgaacgaactgatcgccgcatctaacgtttacaccatcaaaaactacggcccggaccgtgttgctggtttctcgccaattccggcaatgtcgatggtttcttacgcatcgggtgcacgctatctctcgctgattggcggtacttgcttaagcttctacgactggtactgcgacttgcctcctgcgtctccgcaaacctggggcgagcaaactgacgtaccggaatctgctgactggtacaactccagctacatcatcgcctgggggtcaaacgtgccgcagacgcgtaccccggatgctcacttctttactgaagtgcgttacaaagggaccaaaactgttgccgtcacaccagactacgctgaaatcgccaaactgtgcgatctgtggctggcaccgaaacagggcaccgatgcggcaatggcgctggcgatgggccacgtaatgctgcgtgaattccacctcgacaacccaagccagtatttcaccgactatgtgcgtcgctacaccgacatgccgatgctggtgatgctggaagaacgcgacggttactacgctgcaggtcgtatgctgcgcgctgctgatctggttgatgcgctgggccaggaaaacaatccggaatggaaaactgtcgcctttaataccaatggcgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtaggcttcccgtactttggtggcgacggcacggaacacttcaacaaagtggaactggaaaacgtgctgctgcacaaactgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttataccccggcctgggccgagcagattaccggcgtttctcgcagccagattattcgcatcgcccgtgaatttgccgataacgctgataaaacgcacggtcgttcgatgattatcgtcggtgcggggctgaaccactggtatcacctcgatatgaactatcgtggtctgatcaacatgctgattttctgcggctgtgtcggtcagagcgggggcggctgggcgcactatgtaggtcaggaaaaactgcgtccgcaaaccggctggcagccgctggcgtttgcccttgactggcagcgtccggcgcgtcacatgaacagcacttcttatttctataaccactccagccagtggcgttatgaaaccgtcacggcggaagagttgctgtcaccgatggcggacaaatcccgctataccggacacttgatcgactttaacgtccgtgcggaacgcatgggctggctgccgtctgcaccgcagttaggcactaacccgctgactatcgctggcgaagcggaaaaagccgggatgaatccggtggactatacggtgaaatccctgaaagagggttccatccgttttgcggcagaacaaccagaaaacggtaaaaaccacccgcgcaacctgttcatctggcgttctaacctgctcggttcttccggtaaaggtcatgagtttatgctcaagtacctgctggggacggagcacggtatccagggtaaagatctggggcaacagggcggcgtgaagccggaagaagtggactggcaggacaatggtctggaaggcaagctggatctggtggttacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgtcggccatctgggtaaagaaaccgacatcgtcacgctgcctatccagcatgactctgccgctgaactggcgcagccgctggatgtgaaagactggaaaaaaggcgagtgcgacctgatcccaggtaaaaccgcgccacacattatggtcgtagagcgcgattatccggcgacttacgaacgctttacctctatcggcccgctgatggagaaaatcggtaatggcggtaaagggattgcctggaacacccagagcgagatggatctgctgcgtaagctcaactacaccaaagcggaaggtccggcgaaaggccagccgatgctgaacaccgcaattgatgcggcagagatgatcctgacactggcaccggaaaccaacggtcaggtagccgtgaaagcctgggctgccctgagcgaatttaccggtcgtgaccatacgcatctggcgctgaataaagaagacgagaagatccgcttccgcgatattcaggcacagccgcgcaaaattatctccagcccgacctggtctggtctggaagatgaacacgtttcttacaacgccggttacaccaacgttcacgagctgatcccatggcgtacgctctctggtcgtcagcaactgtatcaggatcaccagtggatgcgtgatttcggtgaaagcctgctggtttatcgtccgccgatcgacacccgttcggtgaaagaagtgataggccagaaatccaacggcaaccaggaaaaagcgctcaacttcctgacgccgcaccagaagtggggtatccactccacctacagcgacaacctgctgatgctgactttaggtcgcggtggtccggtggtctggttgagtgaagccgatgccaaagatctgggtatcgccgataacgactggattgaagtcttcaacagcaacggtgctctgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatacggctttaactactatggcaccgtaggttctaaccgcgatgagtttgttgtagtgcgtaagatgaagaacattgactggttagatggcgaaggcaatgaccaggtacaggagagcgtaaaatgaaaattcgttcacaagtcggcatggtgctgaatctcgataagtgcatcggctgccacacctgttcagttacctgtaaaaacgtctggaccagccgtgaaggcgtggaatatgcgtggttcaacaacgtggaaaccaagccgggccagggcttcccgactgactgggaaaaccaggaaaaatacaaaggcggctggatccgtaaaatcaacggcaaactgcagccgcgcatgggtaaccgtgccatgctgctgggtaaaatcttcgctaacccgcatctgccggggatcgacgattattacgagccgttcgattttgactatcagaacctgcataccgcgccggaaggcagcaaatcgcagccgattgcccgtccgcgttcgctgattaccggggaacggatggcgaaaatcgaaaaagggccgaactgggaagatgacctgggcggtgagtttgacaaactggcgaaagacaagaacttcgacaacatccagaaggcgatgtatagccagttcgaaaacaccttcatgatgtatttgccgcgcctgtgcgaacactgcctgaacccggcatgtgtggcgacctgcccgagcggtgcgatttacaagcgtgaagaagatggcatcgtcctgatcgaccaggataaatgccgtggctggcgtatgtgcatcactggatgcccgtacaaaaaaatctacttcaactggaagagcggtaagtctgagaagtgcatcttctgctatccgcgtattgaagcgggtcagccgaccgtgtgctcagaaacctgtgtcggtcgtatccgttatcttggcgtgctgttgtacgatgccgacgctattgaacgtgcagccagcaccgagaacgagaaagatctttaccagcgtcagctggacgtgttcctcgatccgaacgatccgaaagtcatcgagcaggcgattaaagacggtattccgctgagcgttattgaagccgcacagcagtcgccggtttataaaatggcaatggaatggaaactggcgctgccgctgcatccggaatatcgcacactgccgatggtctggtacgtgccgcctctgtctccgattcagtctgcagcagacgcgggtgagctgggtagcaacggcattctgccagacgtcgaaagcctgcgtattccggtacagtatctggcgaatctgctgaccgccggtgataccaaaccggtactgcgcgcactgaaacgtatgctggcgatgcgtcattacaaacgtgctgaaaccgttgacggtaaagttgatacccgtgcgctggaagaggtcggtctgaccgaagcccaggcacaggagatgtaccgttatctggcgattgctaactacgaagatcgctttgtggtgccgagtagtcatcgtgaactggcacgggaagccttcccggagaaaaatggctgcggctttacctttggtgatggctgccacggttcagataccaaattcaatctgttcaacagccgtcgtatcgatgccatcgatgtgaccagcaaaacggagccgcatccatgatcgaactcgtgattgtatcgcgtctccttgaatatccggatgctgccttatggcagcatcaacaagagatgtttgaggcgattgccgcgtcgaaaaatctgccaaaagaggatgcccatgcgctgggcattttcctgcgcgatttaacgacgatggatccgctcgatgcccaggcgcagtacagcgaactgttcgaccgtggccgcgccacgtcactgttgctgtttgaacatgtgcacggcgaatcccgcgaccgcggccaggcgatggtggacctgctggcgcagtacgagcagcacggcttgcagttaaacagccgcgaattgccggaccatctgccgctgtatctggagtacctggcgcagctgccgcaaagcgaagccgtggaaggtttgaaagatatcgcgccgattctggcattgctgagcgcgcgtctgcaacagcgtgaaagccgttatgccgtgctgtttgatctgctgctgaaactggcgaataccgctatcgacagcgacaaagtggcggaaaaaattgccgacgaagcgcgcgatgatacgccgcaggcgctggatgctgtctgggaagaagagcaggttaaattctttgctgacaaaggctgcggtgattcagcaatcactgcgcatcagcgtcgctttgccggtgccgtcgcgccgcaatatctgaatatcaccaccggaggacagcactaatgcaattcctgaatatgttcttctttgatatctacccgtacatagccggggcggtcttcctgattggtagctggctgcgttatgactacgggcagtacacctggcgcgcggcgtccagccagatgctggatcgcaaagggatgaacctggcgtcgaacctgttccatatcgggattctggggatttttgtcggtcacttcttcggtatgctgacgccgcactggatgtatgaagcctggctgccgattgaagtgaaacagaaaatggcaatgtttgctggtggtgccagcggcgtgctgtgtctgattggcggcgtgctgttgctgaaacgtcgtctgttcagcccacgcgtgcgtgcaaccactaccggagcggatatcctgatcctgtcgctgctcgttatccagtgcgcgctgggcctgttgaccattccgttctccgctcagcatatggacggtagcgagatgatgaaactggttggctgggcgcagtcggtggtgaccttccacggtggcgcttctcaacacctcgatggtgtggcgtttatcttccgtctgcacctggtgctggggatgacgttattcctgctgttcccgttctcgcgtctgatacacatctggagcgtaccggtggagtatctgacacgtaagtaccagctggtgcgcgctcgtcactaagcgaattttagttcacatagaccctgcttcggcggggtttttttatgggcacggtgcggggtgagttgtcggatgcgcttcgcttatccgacctacaggggaggatattgtaggcccggtaaacgtggtgccatcgggcaaaattagctcggagtaacaggttttgattatttaaggaagcgatggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttgattgcggattcgtttgagaattccggggcttttgaaagtgatggtggtgggggaaggattactcagcgctgcgcgcttcgcccttcgggtcgttgcctgcggcaacgctctctcgctgacgctcgagccgaaccttagtcgaagcttctcatccttccccgcatgggcagaatatttgattgcggattcgcttgagagttcagggacttttgaaagtgatggtggtgggggaaggattactcagcgctgcgcgcttcgcccttcgggtcgttgcctgcggcaacgctctctcgctggcgctcgagtcgaaccttggtcgaagcttctcatccttccccgcatgggcagaatatttaattgcggattcgttgggaagttcagggacttttgaaagtgatggtggtgggggaaggattcgaaccttcgaagtcgatgacggcagatttacagtctgctccctttggccgctcgggaaccccaccaggggtaattcaaattttgaggtaatgcttgagatggtggtgggggaaggattattcgtcgcttcgctcctcacccttcgggccgttgcctgtggcaacgttctctcgctttcgctcgaatcgaaccttagtcgaaggttctcacccttccccgatgagtgcaaactttcacaatctcaccgaagttaccacatcgctgtggtgaattatggtggtgggggaaggattcgaaccttcgaagtcgatgacggcagatttacagtctgctccctttggccgctcgggaaccccaccacggggtaatgctttttactggcctgctcccttatcgggaagcggggcgcatcatatcaaatgacgcgccgctgtaaagtgttacgttgagaaaaatgaactggttgcgtaattttcatccgtaacggattaaaggtaaccagttatttttgctggcgattaaagaataatcgttcgattaccgtaaacaaagacgcgctgtgccagtactttgtatagtgcacgacttaagacgtttttctcgacgtcacgacctgcgcgcatcatatcttcagctgtgtaggtatgatcgacatgaataacgtcctgcatgatgattgggccttcgtccagattgtcattcacatagtgagcggttgcgccaataatcttcacaccacgttcataggcctggtgataaggacgtgcgccaataaacgctggcaggaatgaatggtgaatattgatgatcttattcgggaagcgtgccacaaattccggcgttaatacccgcatatacttcgccagcaccacgtagtcaggttgataagcatcaatggcatccgccatcttttgatcgtgctcgttgcgggttaacccttcatggcttaccagctcaaacggaatatcaaaacgctcaaccagagaacgtaaagtatcgtggttaccaataactgccgcgatttcgacatccaggccgccgtaattggctttcatcaacaaatcgccaaggcaatgcgcttctttagtgaccagaatcactatccggcgacgaccggcaggattcagctcacgcacggagccttctggcaatgcgctatcgagatccgccagcagggtggaatcattaaaaatcccttccagttccgtgcgcataaaaaagcgcccggtacggtgatcaacaaattcattgttctgtacgatatttaactcgtgcttgtagcaaatattggtaatacgtgcgatcagacctttttggtccggacaaatagtacgcagaactttacgttggagtgaatgcattgctggaaaaaccttgttgagagtgtttgctaaaccgtaccgtcaaccattattggccgcagcactttttaaattttttacctgaaccacaagggcagggatcgttgcgaccaaactgcggacgtgtaccgtcaatatagtaccattgaccgttttctttcaaaaatcgcgaacgttcaattattgcacctgttttaccaccttcggtaaatcgagcaacaaaactgacaaatccgatattgtcggcgtcctgccaacaatgttcaaatacggtcaatcccaaccattcagtatgcgcaaatccggccatcaattcggcacgtaacgccgctgctccacaagagggatgccaggtctttattaaataatctgcgtcttgcatcacaaaagcgcagtaacgcgaacgcatgagatgttctggatcaggtgcaaccttttcaccagacacataagggtggcaacataggctatactcgacagcactaccacagggacaaagctgagacacaaataatctccctggaaacaataacggcgtattaaccgcctgagtagcactatgttaaccgagcagtagcgatgtggctacgattgcattccaggggaatcttgcgggaataatgagaaagataaaaatagggctggcgctgggatctggcgcggcgagaggttggtcgcatattggcgttattaatgcgctaaaaaaagtgggtattgaaattgatatcgttgcaggatgttcaattggttcgctggtgggcgctgcctatgcatgcgatcgattatctgcgctggaagattgggtgacctctttcagttattgggatgttttacgcctgatggatctctcctggcagcgcggtgggttactgcgcggcgagcgtgtcttcaatcaataccgcgaaataatgccggaaacagagatcgaaaattgttcccgtcgctttgcggctgttgccaccaatttaagtacgggacgtgaattatggtttactgaaggcgatctccatcttgctattcgcgcatcatgcagtattccaggactcatggcacctgttgcacataacggctactggctggttgatggagcagtcgttaacccaattcctatttccctcacgcgtgcattgggggctgatattgtgatagcggttgacctgcagcacgatgctcatttgatgcaacaagatttgctctcctttaatgtcagtgaagaaaatagcgagaatggtgattctctgccgtggcatgcgcgtctgaaagaaaggttaggcagcataacgacacgtcgggcggtgacagcgccaacggcaacagagattatgaccacttctatccaggtgctggagaaccgccttaaaaggaaccgcatggcaggtgatccgcccgatattctgattcaacctgtttgcccgcaaatatctacgcttgatttccatcgcgcgcacgctgccattgcggccggacagctggcagtggaaaggaaaatggacgaacttttgccgttggtacgcaccaacatttgaccagaatttttatctacacttaagttaattctgacaggcgcaggtggcaatagcatgccactattgagtaaagccagtcaggggagagaacatgacgcagccattggtcggaaaacagattctcattgttgaagatgagcaggtatttcgctcgcttctggattcatggttttcctcattgggagcgacaacggtactggcggctgatggggtggatgcccttgagttgctgggaggtttcactccagacctgatgatatgtgatatcgcgatgccacgaatgaacgggcttaaactgctggagcatatacgtaacagaggcgaccagaccccagttctggtgatatctgccactgaaaatatggcagatattgccaaagcgttacgtctgggcgttgaagatgttttgctgaaaccagttaaagatctgaatcgcttgcgcgagatggtttttgcctgtctctatcccagcatgtttaattcgcgcgttgaggaagaggaaaggctttttcgcgactgggatgcaatggttgataaccctgccgcagcggcgaaattattacaggaactacaaccgccggttcagcaggtgatttcccattgccgggttaattatcgtcaattggttgccgcggacaaacccggcctggtgcttgatattgccgcactttcggaaaacgatctggcattttattgccttgatgtcacccgagctggacataatggcgtacttgctgccttgttattacgcgcattgtttaacggattattacaggaacagcttgcacaccaaaatcaacggttgccagagttgggcgcgttattgaagcaggtaaaccatttacttcgtcaggccaatctgccggggcagtttccgctattagttggctattatcatcgcgaactgaaaaatctcattctggtttctgcgggtctgaatgcgacgttaaataccggcgaacaccaggtgcaaatcagtaatggtgttccgttaggcactttaggtaacgcttatttgaatcaattgagccagcgatgcgatgcctggcaatgccaaatatggggaaccggtggtcgactgcgcttgatgttgtctgcagaatgagcaaacgataacgcgggctaaatttgcattacctgctaatgtcggctggtggtactatcgtcgccattcgtataagtaattgtcttaattatgctaactcgcctccttttcagaacttagccccttcggggtgctgatatactgggatgcgatacagaaatatgaacacgttcaaaacacgaacagtccaggagaatttaaatggctgccattaatacgaaagtcaaaaaagccgttatccccgttgcgggattaggaaccaggatgttgccggcgacgaaagccatcccgaaagagatgctgccacttgtcgataagccattaattcaatacgtcgtgaatgaatgtattgcggctggcattactgaaattgtgctggttacacactcatctaaaaactctattgaaaaccactttgataccagttttgaactggaagcaatgctggaaaaacgtgtaaaacgtcaactgcttgatgaagtgcagtctatttgtccaccgcacgtgactattatgcaagttcgtcagggtctggcgaaaggcctgggacacgcggtattgtgtgctcacccggtagtgggtgatgaaccggtagctgttattttgcctgatgttattctggatgaatatgaatccgatttgtcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggtgtggtagaaaaaccgaaagcggatgttgcgccgtctaatctcgctattgtgggtcgttacgtacttagcgcggatatttggccgttgctggcaaaaacccctccgggagctggtgatgaaattcagctcaccgacgcaattgatatgctgatcgaaaaagaaacggtggaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaacatccgtatcggtgttatccacgaaacggcgttgagcaatcgacgccgtttttttatagcttattcttattaaattgtcttaaaccggacaataaaaaatcccgccgctggcgggattttaagcaagtgcaatctacaaaagattattgcttgatcaggaaatcgtcgagggatttaccttgctcatccattgcttttttgattacagctggagtacggccttggccagtccaggttttagtttcgccgttttcgtcaacgtagctatattttgccggacgctgagcacgtttagctttggtgccagatttaacggcagcaaggctattcagcagttcgttcgggtcaataccgtcagcgatcagcatttcgcgatattgctgcagtttacgagtgcgctcttcaacttcagcagcagccgcgctttcttcttcgcgacgttcgttaacaacaacttctaatttttccagcatttcttccagcgtttcaagtgtacattctcttgcctgcgcacgaagagtacggatgttgttcagaattttaagtgcttcgctcattgtagtaatctcaaacttatattggggtggtttgttgaggtaataatagagccttaaattcagttgtgcaatagccaggaatgtaaggaattcaaaattgttctttattttgtgccgccaataaatatcttttcataaaattagccagaaaagacgcggcatatagccctatttacaccgatgatttcgcagcacgtgaggttaaaacttcctgattcatgtcacattttatggggagattatcgtaggctgacgacctttcagtcttctgtattagttgtgtttacgagaattccctattaagcgaatgatgaaaagtagaacagtcgcaataagagcatggacttagtattgcactatctcctggaggtcaacagagggctattacttgcgcaacaggttaaagattgtgaatagttaccagcagtcatttacccgcttataacaagcgaggcagttgtaatgatagctcagaaggattatgcaaggcttcgtaagggagaacgcatatacccacttctgtgcatactgttgagctgaaaaactgacgaattatgataaactccagccaactttatttcatatcattgagggcctgtggctgatggcacagctatatttctactattccgcaatgaatgcgggtaagtctacagcattgttgcaatcttcatacaattaccaggaacgcggcatgcgcactgtcgtatatacggcagaaattgatgatcgctttggtgccgggaaagtcagttcgcgtataggtttgtcatcgcctgcaaaattatttaaccaaaattcatcattatttgatgagattcgtgcggaacatgaacagcaggcaattcattgcgtactggttgatgaatgccagtttttaaccagacaacaagtatatgaattatcggaggttgtcgatcaactcgatatacccgtactttgttatggtttacgtaccgattttcgaggtgaattatttattggcagccaatacttactggcatggtccgacaaactggttgaattaaaaaccatctgtttttgtggccgtaaagcaagcatggtgctgcgtcttgatcaagcaggcagaccttataacgaaggtgagcaggtggtaattggtggtaatgaacgatacgtttctgtatgccgtaaacactataaagaggcgttacaagtcgactcattaacggctattcaggaaaggcatcgccacgattaataagaatttctttactgacagggtgagcagggcacttttatcctgtcagttcgttttacgcacttcttccgggctatatacccttctcggcagttttttaacgccgctatacgcctcacagggctcttaagcaccgacgttgacttgtgacctgtaaagtacaatatccctgtgtttaggcgttatacatcgtcgcaaatatgatgaaggctaatgctgtcggtttatggaaaagttgctttgggtaaacaaaaaatacggccccagaagggcaatgccgttcacttaagaggagcggcactatgtttcacaggataacgggtttttgatatcttaaccgacctcggccttgatggtcgggggcgttttgttatgaacaccacttccagagcaccccgaagatgctccagtcgtttcgggatggtccctggtgacgccgtgtttcccagctctatcatttctgatgcgatattcttccacgcaggcagtagccagtggcggttacaacccttctggttcagcgtcagcagcaggtcttcgctgtaaaaaagtttatcaaacaacgtaatagagttatccgggatggtggcgagcatggagtgggccagcacagtttcgctctgccggtaaggtgcggtcacggcattcagcagaatgtgacttcccaggttcattaaggccaccagacgcataaccgggtaggcgttctgccgcttagtggatgtgttggcagacccataatattcacgcagctcgggtttatcaggtgtcctgaactgtgcgccatcaatggcaaaaagttgcaggccgtgccagtcatccttcaggtaacgttccgcgcccctgtctgtgcggtctggcggaagagccattccactggggcggcccccacgcgctgacgcgcctgggtgacagcgctgcgggccagcaggttcatccccgcttcgccatccgcgctcaggttcagacggcgaacaacatcggtaattggctcattgcaccaccatccagataaccatgtcccccggtaaacgacggcggcgaacggtcgcatgagcagaaagcgtcaggcagtgttgtatccactcggtgggaaggtgttctgcaaatagttgtgcagagggcggaggcataagcggatggtcactgaaatcgagcagatcattgagaagtggcataagaaaacggctccctgttgtggaagccgttatagtgcctcagtttaaggatcggtcaactaatccttaactgatcggcattgcccagaaggggccgtttatgttgccagacagcgctactgattaagcggattttttcgcttttttctcagctttagccggagcagcttctttcttcgctgcagtttcaccttctacataatcacgaccgtagtaggtatccagcagaatctgtttcagctcggagatcagcgggtaacgcgggttagcgccggtgcactggtcatcgaatgcatcttcagacagtttatccacgttcgccaggaagtctgcttcctgaacgccagcttcacggatagatttcggaatacccagttcagctttcagcgtttccagccatgccagcagtttctcgatcttagcagcagtacggtcgcccggtgcgctcagacccaagtggtcggcaatttcagcataacgacggcgagcctgcggacggtcatactggctgaatgcagtctgcttggtcgggttgtcgttcgcattgtagcgaataacgttacaaatcagcagggcgtttgccagaccgtgcggaatatggaactgggaacccagtttgtgcgccattgagtgacatacacccaggaaggcgttcgcaaacgcgatacccgcgatagtcgctgcactgtgaacacgttcacgcgctaccggatttttagacccttcgtggtaggacgctggcagatattctttcagcagtttcagtgcctgcagagcctgaccatcagagaactcagatgccagtacagaaacataagcttccatggcgtgagttactgcgtccagaccaccgaaagcacacagggacttcggcatgtccataaccaggttggcgtcgacaatcgccatatccggagtcagcgcatagtctgccagcggatatttctgaccagtagcgtcgtcagttacaaccgcaaacggagtgacttcagaacctgtaccagaagtggtggtgacagcgatcattttcgctttcacgcccattttcgggaacttgtagatacgtttacggatatccataaagcgcagcgccagctcttcgaagtgagtttccggatgttcgtacataacccacatgatcttcgcggcgtccatcggggaaccaccacccagcgcgataatcacgtctggtttgaaggagtttgccagttctgcacctttacgaacgatgctcagggtcgggtccgcttctacttcgaagaagacttcagtttcaacgcctgctgctttcagtacggaagtgatctgatcagcataaccattgttgaacaggaagcggtcagtcacgatgagcgcacgtttgtggccatcagtaatcacttcatccagcgcgattggcagggagccacggcggaagtagatagatttcggaagtttgtgccacaacatgttttcagctcgcttagcaacggttttcttgttgatcaggtgtttcggaccaacgttttcagagatggagttaccaccccaagaaccacaacccagagtcagggaaggtgcgagtttgaagttatacaggtcaccgataccaccctgagacgctggggtgttaatcaggatacgcgccgttttcattttctgaccgaagtaagaaacgcgagccggttggttatcctggtcagtgtacaggcaagaggtatgaccgataccgcccatagcaaccagtttctctgctttttctaccgcgtcttcgaaatctttagcgcggtacattgccagagtcggggacagtttttcatgtgcgaacggttcgctttcatcaacaacggtcacttcaccgatcagaatcttggtgttttctggtacagagaagcctgccagttcagcaattttataggctggctgaccaacgatagccgcgttcagcgcaccgtttttcaggataacatcctgaacagctttcagctctttaccctgcaacagatagccgccgtgggttgcaaaacgttcacgtacagcgtcataaacagagtcaacaacaacaacagactgttcagaagcacagattacgccgttgtcgaaggttttggacatcagtacagatgcaactgcacgtttgatatcagcagtttcatcgataacaactggagtgttgcccgcgcctacaccgatagctggtttaccggagctgtatgcggctttaaccatgcccggaccaccagtcgcgaggatcaggttgatgtctgggtggtgcatcagtgcgttagacagttcaacagaaggttgatcgatccagccgatcagatctttcggagcaccggcagcgatagcagcctgcagaacgatatcagccgctttgttggtggcatcttttgcacgcgggtgcggggagaagataatggcgttacgggtcttcagactgatcagcgatttgaagatagcagttgaagtcgggttagtggtcggaacgataccgcaaataataccgattggttcagcgatagtgatggtaccaaaagtgtcgtcttcagacagaacaccacaggttttttcatctttataggcgttgtagatatattcagaagcaaagtggtttttgatcactttatcttcgacgatacccatgccggattcggcaacggccattttcgcgagtgggattcgagcatctgcagcagccagagcggcggcgcggaagattttgtctacttgctcttgagtgaaactggcatattcacgctgggctttttttacacgctctacgagtgcgttaagttcagcgacattagtaacagccataatgctctcctgataatgttaaacttttttagtaaatcatctgctcgaatacgagagtatagtcagtgcggtgatgatttgcttaacctatgaaaatcaaaagcttactcgcgctcacactcactgtgatttactaaaagagtttaaacattagagttattatctctaatgcgtcacttccaggtggcgtaagcaagattactcacttctgggtactgattacgtgatccaaatcaaatttttgcaaagctgacacctttcagcatcgcttttcgccattatagctaacagttaataaattgtagtatgatttggtggctacattagcatgttttgcacaactagataacaataacgaatgatagcaattttaagtagttaggaggtgaaaaatgctgtcaaaaggcgtattgtcagcgcgtcttttcaaccttatttatggctaacattatccggcttttgcttcggagctaaccgtgattcagaccttttttgattttcccgtttacttcaaatttttcatcgggttatttgcgctggtcaacccggtagggattattcccgtctttatcagcatgaccagttatcagacagcggcagcgcgaaacaaaactaaccttacagccaacctgtctgtggccattatcttgtggatctcgctttttctcggcgacacgattctacaactttttggtatatcaattgattcgttccgtatcgccgggggtatcctggtggtgacaatagcgatgtcgatgatcagcggcaagcttggcgaggataaacagaacaagcaagaaaaatcagaaaccgcggtacgtgaaagcattggtgtggtgccactggcgttgccgttgatggcggggccaggggcgatcagttctaccatcgtctggggtacgcgttatcacagcattagctatctgtttggtttctttgtggctattgcattgttcgctttatgttgttggggattgttccgcatggcaccgtggctggtacgggttttacgccagaccggcatcaacgtgattacgcgtattatggggctattgctgatggcattggggattgaatttatcgttactggtattaaggggattttccccggcctgcttaattaattcctttcaaatgaaacggagctgccatgctccgtttacttcgtcattatttttactttgttcccgcgcagttatcaaaagcaaaaggaataggtaaaaatattcttctcaaattacagttagttataaggatttccttaactgcttctcctcaccatcatgttattttcgccacatcataatcctgggcttgctgaagaataattgaaatgatattattaattccactgcctttggtagaggaaagtgctaaataataatcaattgttaaattattgtgcatttcactactggaactgtaatcagaaaagatagacatgcttagccaatctctatttgattgaattgaaagatgtttgttaaggcatggatgcaagctatagattctgatacggtcaataaaagagaattgcttaacaattttgcaaaatgtattggcgagtaagaaccgcatttggtactttccgggcaaccgccagacgattctttattggtaatgagaataattaacaattaaagagcgtcgcgaaagaataatgtgtctcgacaggggagacacagtacgaatcgacataaggtgatcgtctgaatcaccagaataaataaagtcggtgatagtaatacgtaacgataaagtaacctgacagcagaaagtctccgagcctgtgcagggtcccaatccgggattacacatgctggttaataccagtaattataatgagggagtccaaaaaacaatgaccaacatcaccaagagaagtttagtagcagctggcgttctggctgcgctaatggcagggaatgtcgcgctggcagctgatgtacccgcaggcgtcacactggcggaaaaacaaacactggtacgtaacaatggttcagaagttcagtcattagatccgcacaaaattgaaggtgttccggagtctaatatcagccgagacctgtttgaaggcttactggtcagcgatcttgacggtcatccagcacctggcgtcgctgaatcctgggataataaagacgcgaaagtctggaccttccatttgcgtaaagatgcgaaatggtctgatggcacgccagtcacagcacaagactttgtgtatagctggcaacgttctgttgatccgaacactgcttctccgtatgccagttatctgcaatatgggcatatcgccggtattgatgaaattcttgaagggaaaaaaccgattaccgatctcggcgtgaaagctattgatgatcacacattagaagtcaccttaagtgaacccgttccgtacttctataaattacttgttcacccatcaacttcaccggtgccaaaagccgctatcgagaaattcggcgaaaaatggacccagcctggtaatatcgtcaccaacggtgcctataccttaaaagattgggtcgtaaacgaacgaatcgttcttgaacgcagcccgacctactggaacaacgcgaaaaccgttattaaccaggtaacctatttgcctattgcttctgaagttaccgatgtcaaccgctaccgtagtggtgaaatcgacatgacgaataacagcatgccgatcgaattgttccagaagctgaaaaaagagatcccggacgaagttcacgttgatccatacctgtgcacttactattacgaaattaacaaccagaaaccgccattcaacgatgtgcgtgtgcgtaccgcactgaaactaggtatggaccgcgatatcattgttaataaagtgaaagcgcagggcaacatgcccgcctatggttacactccaccgtatactgatggcgcaaaattgactcagccagaatggtttggctggagccaggaaaaacgtaacgaagaagcgaaaaaactgctggctgaagcgggttataccgcagacaaaccgttgaccatcaacctgttgtataacacctccgatctgcataaaaagctggcgattgctgcctcttcattgtggaagaaaaacattggtgtaaacgtcaaactggttaaccaggagtggaaaacgttcctcgacacccgtcaccagggtacttttgatgtggcccgtgcaggctggtgtgctgactacaacgaaccaacttccttcctgaacaccatgctttcgaacagctcgatgaataccgcgcattataagagcccggcctttgacagcattatggcggaaacgctgaaagtgactgacgaggcgcagcgcacagctctgtacactaaagcagaacaacagctggataaggattcggccattgttcctgtttattactacgtgaatgcgcgtctggtgaaaccgtgggttggtggctataccggcaaagatccgctggataatacctatacccggaatatgtacattgtgaagcactaatggcaatacgtggggcaggagtgtcctgctccacggtgtctgatttttatcgcattacagaaggcacaggccagaaggtagggcaatgttaaaatttattctacgtcgctgtctggaagcgattccgacgctatttattcttattactatttcgttctttatgatgcgcctcgcgccgggaagcccttttaccggcgaacgtactttaccgccagaagtgatggccaatatcgaagcgaaatatcatcttaatgatccgatcatgacacagtatttcagctacctgaaacaactggcgcacggtgatttcggtccatcgtttaaatataaagattattcggtcaatgacttggttgcatccagttttcccgtttctgccaaactgggagccgcagcatttttccttgcggtaatactgggtgttagtgctggcgttattgccgcattaaaacaaaacaccaaatgggactataccgtgatggggctggcaatgaccggggttgttatccccagttttgtggttgcaccattattagtcatgatatttgcgatcattttgcattggctgccgggcggtggctggaatggtggggcgcttaaattcatgatattgccgatggtggcgttgtcactcgcttatatcgccagtattgcgcgtattacccgtggctctatgattgaagtattacactccaattttattcgtactgcccgggcgaaagggttacctatgcggcggatcattttacgtcacgcattaaaacctgctctgttacccgtgctctcttatatgggccccgcatttgtcggcattattaccggttctatggttatcgaaaccatttatggtttgccggggattggacaactgttcgttaatggcgcattgaaccgtgactattccttagtgttaagcctgaccatcctggttggtgctttaaccattttgtttaatgccattgtcgatgtgctatatgcggttatcgacccgaaaatccgttactgatactggagctcgcgatgatgttaagtaagaaaaacagcgagacgctggaaaatttcagtgaaaagctggaggtcgaagggcgcagcttgtggcaggacgcacgtcgacgttttatgcataaccgtgcggcggttgccagtctgatagtgctggtgctgatcgcgttatttgtaatcctggcaccgatgctttcccagtttgcctatgacgatactgactgggcgatgatgtccagcgccccggatatggagtccggtcactactttggtactgactcatccggtcgcgacctgcttgtgcgcgttgcgattggcgggcgtatctcactcatggtcggtgttgctgcggcactggtggctgtggtcgtcgggacactttatggttcgctttccggttatctgggcggtaaagtggattcggtaatgatgcgtctgctggaaatcctcaactccttcccattcatgttcttcgtcattttgctggtgacctttttcggtcaaaacatcctgctgattttcgtggcgataggcatggtttcctggctggatatggctcgtattgtgcgtgggcaaaccctgagtctgaagcgcaaagagtttattgaggcggcacaagttggcggtgtatcgacatcgggcattgttattcgccacattgtgccgaatgtactcggtgtggtggtggtctacgcatcacttctggtgcccagcatgatcctctttgaatctttccttagcttcctggggttgggtacgcaagagccgttaagcagctggggtgcattgctgagtgatggcgcgaactcgatggaagtctctccatggttattgttgttcccagcgggattcctcgtggtgacgctgttttgtttcaactttatcggcgatggcttgcgtgatgccctcgacccgaaagatcgttaaggagtgcagccatgagcgtaattgaaactgcaactgtgccgctcgcacaacaacaggctgacgcactgctgaacgtgaaagatttgcgtgtcacctttagtaccccggacggcgacgtcacggcggtcaatgatttgaatttttccctacgtgccggagaaacgctgggtattgtaggtgagtctggttcgggtaaatcgcaaactgcatttgcgttgatgggcctgttggctgccaacggacgtattggcggatcggcaaccttcaatgggcgtgaaatcctcaatttgccagagcatgaactcaataaactgcgcgctgaacaaatctcaatgatttttcaggacccaatgacttcgttgaatccctatatgcgcgtcggtgagcagttgatggaagtgctgatgctgcataagaacatgagcaaagctgaggcgtttgaagagtcggtgcggatgctcgatgcggtaaaaatgccggaagcgcgtaaacgcatgaaaatgtacccgcacgaattttctggcggcatgcgtcagcgagtcatgattgcgatggccttgttatgtcgacctaagctgctgattgcggatgaaccaacaactgcgctggacgtcaccgtacaggcgcagatcatgacgctattaaatgaactgaagcgggaatttaataccgccatcattatgatcacccacgatcttgtcgtggtggcggggatctgcgacaaagtgctggtaatgtacgccgggcgcacgatggaatatggcaacgcgcgcgatgtcttttatcaacccgttcatccttattctatcggtttgctcaacgcggtgccgcgtctcgatgcggaaggtgaaacaatgttgaccatcccgggtaatccgccaaacctgctgcgattaccgaaaggttgcccgttccagccacgttgtccgcatgcgatggaaatttgtagtagcgcaccgccgctggaagagtttacgcctggccgtctgcgtgcttgctttaaaccggtggaggaactgttatgaatgctgtaactgaaggaagaaaagtcctccttgaaatcgccgatcttaaagtgcactttgaaatcaaagatggcaaacagtggttctggcaaccgccgaaaacgctcaaagccgtcgatggtgtcactcttcgcctgtatgaaggggaaacattaggtgtggtaggggaatcgggatgcggtaagtccacctttgctcgcgccatcatcggtttggtcaaggcgaccgacggtcatgttgcctggttaggtaaagagttgctgggcatgaaacccgatgaatggcgtgccgttcgcagtgatattcagatgattttccaggatccgttggcatcgctaaacccgcgtatgaccatcggcgagatcatcgctgaaccactgcgtacttatcatccgaaaatgtcacgccaggaagttcgcgagcgcgtgaaggcgatgatgctgaaagtcgggttattgcctaacctgattaaccgctatccgcatgagttctctggtgggcagtgccagcgtatcgggattgcgcgtgctcttattcttgaaccgaagctgattatctgtgatgagccggtgtcggcgctggacgtgtcaattcaggcacaggtggtcaacctgctccagcaattgcaacgtgagatgggattgtcattaatttttatcgctcatgacctggccgtggtaaaacacatttccgatcgtgtgttggtgatgtatctcggccatgcggtagaactggggacctatgatgaggtctaccacaatccactacatccttacaccagggcattgatgtcggcagtccccatacctgatccggatctggagaagaacaaaaccatccagttactggaaggggaattaccgtcgccgatcaacccgccttccggttgtgttttccgtacccgttgcccgattgccggtccagagtgcgccaaaacacgtcctgttctggaggggagtttcagacactccgtttcttgcctgaaagtcgatccgctttaaaaacaataagggctgacagttgtcagccctttttcacgctaaaagcgattatttattcccgccagatgatatggcaaagtttgtgatctttttcgcggcataacagaatgcgggcaaaaacatcgttgatttcaccatcttcactgtccgccagaccaatcaccacttcggcaaaaaagtccgggttcaaatcgaaatcaacatgttcctgccagtcttccgccggatcgaataactccgcgccgccgcgctcttcaaactgaagattgaacagcagaacatcagctggatcgagattgtcggcagccagttcgagaaaaatatcgtaggcctgttcaagcgtttcatcttcagtcaggcgattgtttagatccatatccatagttactacctgtttaacctctgttggcgacgttttacagcaacggactgaagaagtaaaacagtcgctcggcgacacgttgccataatggacgttttagccataaacgggcatcgagcagacgtgaacgcgaaatataatcgtcctgaacggcggcgaggtcagcaccaaaacctttatcgtcgattgccagggtaatctcgaaatttagccacagactacgcatatcaaggttaactgtgccaaccagacttagttcgccatcgaccagcacgctcttggtatgcagtaacccgccttcaaactgataaattttaaccccagcagccagcagttccgtaaagaatgcgcgactggcccagccgaccagcatcgagtcattttttcgcggaaggataatactgacatccaccccgcgctgcgccgccgtgcaaatcgcatgaagtaaatcatcgcttggcacaaagtagggcgtggtcatgatcaaatattcacgcgccgaataagccgcagtcaataatgcctggtgaatgagatcttccggaaagccggggccagaagcaattgtgtgaatggtgtgaccgctggcctgttcaaacggcataatattgacatctggtggtggcggcagaatacgttttccggtttcaatctcccagtcgcaggaataaataatccccatcgcggtggcgatagggccttccatacgcgccatcagatcaatccattgccctacgcccgcatcttgtttgaagtagcgaggatcgaccatattcatgctgccggtgtacgcgatgtaattatcgatcatgatcatcttgcgatgttggcgcaggtccatacggcgtaaaaacacacgcatcagattgacctttaaggcttcgaccacttcaataccggcattacgcattagctcgggccacgggctgcggaaaaaagccacactcccggcggagtcgagcatcaatcggcaatgaatgccgcgtcgcgcagccgccattaatgattcagccacctggtccgccatgccgccgggctgccagatataaaacaccatctcaatattatggcgcgcgagctggatgtcgcggattaacgcctgcatcacatcatctgactcggtcatcagttgtagctgattccctttgaccccagcgatcccctgacgacgctcgcaaagcttgaataatggcgcagcgacactgctattttcttcggcgaagatatgcttacaggctttaaggtcgttaagccattttgcggtggaaggccacatcgctctggcgcgctcagcgcggcgtttgcctaaatggagctcgccaacggcaagataggcaataattccgactaacggcagaatgtaaataatcaacagccaggccatcgcggagggaactgcgcgtcgtttcattagaatgcgtaaagttacgcctgcaatgagcaaccagtatcccagaatggccaaccaactcaccaacgtataaacggttgtcatagattagaaatccttttgaaagcgcattgttatgagtttacgcatatggattcatctggcaaataaaaacgcgggaaaagcactggtcagcgtcgggggtgggggtataatgaccattctgttattgcatagagtagttaacatgaagcggagtagaacggaagtggggcgctggcgcatgcagcgtcaggctagccgacgtaaatcgcgttggcttgaggggcaatcgcgccgaaatatgcgtatccacagcatcaggaagtgcattctaaacaaacagcgtaactcgttattgtttgcgatctacaatatctaaatgtactgggcaccattgcggtgcccaataagtttactcttccgtctttaaactctatttttgcgccgattctttactgtcagctttcgtttctagttcatcgttatcgctgaaaataccatgacctgagttcaacaacattgaaacgagcatatcattattaatctcttcaccatttaaaactcgcgccagaatttcgctgccaaacagttgcggtgagagaatgatatccggatgtaccatcttaatcttattcaggtttttgctatcactgacggcgagaactgttttgacatcactgctcatatcttttgccgagagtacaacaaacgcgttatctgcatcgttatcactcagcgccagaatggcccggcaacgatcgattcccgctttctttaatacagaactgtcattactgtcaccggggataacatcagcattatcgcctaagcgttgctcaagttgcttgatatcatcttcaggcaagttgctgataaccgttacgttttgtccgcgttgattcagttgcaggatcgtattgatggcgagaatcgaatgtccgcaaacaataaaatgatctttacgatgcattgtatgattgtttccttttacaagtttgttgaatcccccgcggataagcggaccaaaaattgaggtcatagatgtggcaaaaacggtaatgccggaaataatgaccgaaatagtgaacaatcgtgctgattcagaaacagggacaatatcgccatagccgacggttgacatggtttctatcgaaaaatagaacgcggtcatcaaactttctattcgcggattaaaaccttcgcttaaataaagcgcaccgtaggttgagtaaaacagtaatgtcgtgaaactaataaatgcaaaaattgtcccggctgcggcgctactgtgggagaagtctttgcgcagtatcagcaaaaacaccagcgtaaaaatgcaaaatccaatactaaatttcagccagggataaaaatgcagggtgtaaattagcgctatcaacaacaaaatgatactgattgcccatgcgagctttgcccggaacagtaagccaatggagttcaggacaagaaagacgccgagcataaagagtggggcgtttgccagcaaggagagatccaactctgaaaatgctttgatatggaaaatatcaagcaaattgaccgacataccatagattgttttaaaaataagcaatccatttaaaaagacggccagcgcgagaatgtcgtgccgaagggtcacccataaatttgttgctgtttgtttgaatgtagcccagtgactcactgatacctctgtaaccacaattttgtttaattatcttagcgtgcacattttctgaacatacatgcagcgcgtgaatgtgttaaacaatagtagatgactttatccgcagtaatcaaaggatttgagcgagcaactgtacctcaggaaaggtcatttttcctgaatatgctcacatcatataaagaaatacagataaagttattatctgcttgtggtggtgaatgcactgaccggctataaggaaaggccaaacaagaacacggttgcaaaaaccgtgcccttaaatattgaatctctattcagaacactttcttaaatggtttcactgaaacgtgttcatagactcctgccgctacgtacgggtcagcatcggcccaggcctgagctgcttccagcgattcaaattcagcaataacggttgagccagtaaatcccgcagcccctggatcgttactgtctaccgctggcattggaccagctgtcaacaaacgaccttcatcatgcagtaactgtaaacgtgctaaatgtgccggacgaacggaaaggcgtttttcgaggctatcagctttgtcttgagcgtaaataacatacaacacgggcacaactccttgttcgggaaagttgtaaagtacgttatttgaaagggcgaagatctgcaacggaaagatgatgtctttgttaaggccatgcataaagtaagggtaattacgccaaaaatgacattttcactgatcctgatcgtcttgccttattgaatatgattgctatttgcatttaaaatcgagacctggtttttctactgaaatgattatgacttcaatgacccttgatttacctcgccgcttcccctggccgacgttactttcggtctgcattcatggtgctgttgtggcgggtctgctctatacctcggtacatcaggttattgaactacctgcgcctgcgcagccgatttctgtcacgatggttacgcctgctgatctcgaaccgccacaagccgttcagccgccaccggagccggtggtagagccagaaccggaacctgagccgatccccgaaccgccaaaagaagcaccggtggtcattgaaaagccgaagccgaaacctaagccaaaaccgaagccggtgaaaaaggtacaggagcagccaaaacgcgatgtcaaacccgtagagtcgcgtccggcatcaccgtttgaaaatacggcaccggcacgcctgacatcaagtacagcaacggctgcaaccagcaagccggttaccagtgtggcttcaggaccacgcgcattaagccgtaatcagccgcagtatccggcacgagcacaggcattgcgcattgaagggcaggttaaagttaaatttgacgttacgccggatggtcgcgtggataacgtacaaatcctctcagccaagcctgcgaacatgtttgagcgtgaggtgaaaaatgcgatgcgcagatggcgttatgagccgggtaagccaggcagtgggattgtggtgaatatcctgtttaaaattaacggcaccaccgaaattcagtaagcagaaagtcaaaagcctccgaccggaggcttttgactattactcaacaggtaaggcgcgaggttttccttcaggatcaaccgcgacatacttaaataatgcttctgtcgctttatagcgttgcccaattggttcagacgctacttttttcacccacacttcaatattaatgctgaccgatgtcgtccctttctggacacagcgtgcatagcagcacaccacatcgccgaccgcaaccggccgtaagaaagtcattccttcaacccgcacagtcactacgcgaccgtgggcaatttcttttgccagaatagcgccgccaatatccatttgtgacattaaccaaccaccaaagatgtcaccattggcattggtatcggcgggcatggctaaagtacgtaaaacaagatcgccctgagggacgttatgtgttgtagacatggtaaaaccgacttaaaaggaaaatcacaggcgcgatgctactatgattttcctgaggagaacagaggagatacagcgccagccccgaaggactggcagtctggttaggatttatcttcctgcggcatgtggcggtagatatagataccgcttaacaatgtgaagattaaggtaagggcggtcaggccaaagactttaaagttgacccaaatattttgcggcagccagaatgcgatgtagatgtttgccagaccgcaaaggataaagaaaacagcccaggccagattcagcttcgaccataccggttgcggcagcgtgagttctttacccagcatccgctgaattagcggctttttcatcacccattggctgactaacagggctcccgcaaatagagcataaatgacagtaaccttccatttaataaactcatcattgtggaagaacagcgtcaagccaccgaagacgaccaccagaacaaaagtgatcagggccatcttctcaaccttacgaaagcgaacccagctatagataagcacaatcgccgtggcgacgatcagcgccgcagtagccgcatagatgtcataaatcttgtaaaacgcgaaaaagacaaccagcggtaaaaaatcaagaaactgcttcattttacgattccgtaatcaaatgcttaaggttattggcgaatcaacatatacaggcggaacagatagatgagcaatatggctgaaatcaggttgctcaaggtgttcgccagtacggcaccaatttccggggttaatgcggcaaaagaagaggcaaaaagcagcaacagtgtttttgccagcaaccagctcagtactgcgggtgccaccagacgcatattcgcccaagtcagccgcatactgctacgcatcgaggcaaaaacgcccattttgtcctgtaccaacatcaccggtgccagggccagtaaaatggccatgataattcccggaacgaccaccagcatgatgccaatctgtactaaaagggtagtcagaaaaatcagaataaataactttggcaatatcggcgcactggcaccaatagctcgcagcgcactgactctctgacccgcagacaccagctggataattaatattacgcctccggcgagaatggcgttaccgattaatcctgaaaaagtggacgccgctgaagcctgcagcaaaatttgttgctgttccggtgacatattctgaaccaggtcgaacaacccactactgccgctaacgggcacgccgtcattgagctgcgcaagctgtgcatcactgggtgagaaaacatgccctaacaccactgtgataaacgcacatagcaacgataccaacagaatggtcataaattgattacggaagaaatttccggtgtcacggtatacggactgcgccgtgatagacatgcactctccttgagttttatgcaggtgttaattagcgggcaattgtaccctggttaagcctcgggtggcagcatcaggtcttgtatggaaaagcatatctttgtaaagcggaggtaattgctggccttcaggcatgggcaaatcgcggcaagtggcgaccgagttaatatttgcgtagcgaaaatatttaaaaattgatttaaatcacattaaccaggattctcaatgcaacttctaaattaatccagatcaataaagggtgaattatcatatgtaatgtgatctatgtaggatcatttgttactccaatgtaggtatattcgtcacgtttttataaccataacgacggagcggatatgaaaaagttaacagtggcggctttggcagtaacaactcttctctctggcagtgcctttgcgcatgaagcaggcgaattttttatgcgtgcaggttctgcaaccgtacgtccaacagaaggtgctggtggtacgttaggaagtctgggtggattcagcgtgaccaataacacgcaactgggccttacgtttacttatatggcgaccgacaacattggtgtggaattactggcagcgacgccgttccgccataaaatcggcacccgggcgaccggcgatattgcaaccgttcatcatctgccaccaacactgatggcgcagtggtattttggtgatgccagcagcaaattccgtccttacgttggggcaggtattaactacaccaccttctttgataatggatttaacgatcatggcaaagaggcagggctttccgatctcagtctgaaagattcctggggagctgccgggcaggtgggggttgattatctgattaaccgtgactggttggttaacatgtcagtgtggtacatggatatcgataccaccgccaattataagctgggcggtgcacagcaacacgatagcgtacgcctcgatccgtgggtgtttatgttctcagcaggatatcgtttttaattccgcacaaaaacgaccccgtaatatacggggtcaataaggacatggtataaagggtattatttcttcgcttctacgccatcagtttcagagcgaattaaaaatttctcagttgtttgcggaatattctgaatcagccagtcggccatttgcttttcctcatttaaaatcgcttcgatggttggaattgaagctgtatcaccggcattttttgctgctgctaatagtgaggtgtaacaggcgatttcaaattgctcgaagacatatccgctaatagagcctttgactatttcatcagaagggaatataccaccgattgactgcccaagcgcagccattttactcatggaatctttaatgactgaacgtgaaatgtcattacgatcaagaatagtttccagttgaacaatctggtttttggtttcactaagatgttgttcaatacgagcgcgtagttcaggataattatctatacggctggccatggattcaagcatagattcggcttgcttttccattgcgtgggcgtcacgtaaccagtcatgataatgttcaatacgattcatgaaaatgtcctctttataaaatgactaaaagttaaaattcatatttcaggctttattttcggctttcttatttacgttattaatggccagatcagtcagtttgatgtcggtggccttttcttcttccagggtttctttcagaagcttcgctgctttacggtaacctaattgttcagccagcgtcgctaatgtcccgtaactggcaatctcataatgctcgactttctgtgctgcggcaatcagtgcggcatcacgcacttcgtttttctcggtactttcgatgacctcattagcttcttcaataagaccttccattgccacacatttcatgcgcttaattttcaggttcgattcggactccacaacttgatcaatacgttcaatctgtccatgagtttcctcgaggtgcgcatgaaaagcctgacttaatttttcatttgatgttgctcttgcgagttttgccagtgcccgggttaattgtttttctgcgctgtaggtatctgaaagcaggtgaataaatacatcttcaatggtcttcatattcatatttttctccagtgaaatcactgcgagccatacggcccgcagatgcaattatctttatcagctgatattaataattaacggtgaatcaggatttgcctgatttattaccaccgctttgttgaccgccttttttacccgcttcagatgcgcgttgcggatcatttttaaaattaccgccgctatgctgaccgcctttacggcctgcgtcggatgccttctcacggtcttcggcgaaatttcctgaaccaccacgatgttcggccatgttatttctcccgttgcgttgcattgtttcattaatatgagtgttgtgtgtcgacactcattaaaattagtcgctaatgagaattagtcaaattaagcgcaacgagaagatagagggaaaatatattttgaggaacattctggatatattaacaattacctgaggaataagtgacttagagaaaattattgattttactggtgttatgttgcgggattaatttgtttgattatattactgttgggcggaaaaatgacgtaagttgacgttcgaccggggtaagcgaaacggtaaaaagataaatattaaatgaatttaggatttttccggcttcattaaagaaagttaaaatgccgccagcggaactggcggctgtgggattaactgcgcgtcgccgctttcatcggttgtacaaaaactttcagtgccgccagcattttctctggctcattaatatgttgctcgatgattttaacaatggccgaaccagaaatcgcgcccgcagctcctgcatcaatcgctgcttttacctgatccggggcggaaataccaaatccctgcaatggaggtgcagcgttgtactctttcagcttcgcaaccagatgattgaggggtaacgcggcgcggttttctgcgccggtcacgcctgctcgtgacagcaaataggtgtaaccacgaccgtaagaggctatctggcgcagcaggtcgtcatcggcatttggcgggcagatgaagataggtgcgacattatgacgcaacgcggcctggcggaagggcgcggactcttcaactggcacatcggcaaccagcaccgaatcgacgccgactttttcgcactgggcataaaactcatcaatgcctttgttaaacaccagattggcatacatcaacaggccaatgggaatggtcgggtgtttctggcgaatcagtgccagcatttcaaaacattgtgccggagtcacacctgccgcaaaggcgcgcagagtggcgttttgaatcgtcgggccatccgccagtgggtcggagaaggggatacctaactccagcgcgtcagcaccggcttcaattagcgtatcgataattttcaatgactgctcaatgcccggatcaccgagcgtgacgaaaggaacgaatgcgccttctttgcgctccttcaactgggcaaacagagattcgtagcgttccatcagatttcccctcgtgctttcaaaatatcgtgaacggtgaagatgtctttatcgccgcgaccggaaaggttaaccaccagtagctgctctttatccgggttttcgcgcatcattttcaacgcatgggccagggcgtgggaggattccagcgccgggatgatcccttcgtgcaggcacagcgttttgaaggcttcaagggcttcatcatcggtaatagacacgtaatcagcgcgtccagtgctgttaagatacgcgtgttgtgggccgacagacgggaaatccagtccggcggagatggagtaagattcttcaatctgcccgtcttcggtttgcatcatcggcgctttcataccgaaatagatacccacgcgaccatgttttagcggtgcgccgtgctcgccagtttcgataccgtgaccacctggctccacaccaatcaggccgacgttggtttcattgatgaaatcagcaaacatgccgatggcattcgaaccgccgccaacacaggcgataacggcatccggcaggcgaccttctctttccagaatctgcgctttggtttcttcgccaatcatccgctgaaactcacgcacaatggtcggataaggatgcgggccagctgcggtgcccagcatatagtgcgcggtttcgtaactaccggaccagtcgcgcagcgcctcgttacaggcatctttcagcgtcgcggaaccgctatgcaccgggatcacttccgcacccattaagcgcatacgaaaaacgttaggcgactggcgttcaacgtctttggcacccatataaatacggcatttcaggccgagcagggcgctggcaagggccgacgccacgccatgctgaccggcaccggtttcggcgatgatttcggttttacccatccgcttcgccagcaacgcctgccccagcacctggttagttttatgcgcgccgccgtgcagcaaatcttcacgcttgagatacagcgtggtgttcgtcccggctgtaatgttctggcatttggtcagcgcggttggacgcccggcatagtttttcagcaggtcgttgaactgagcctgaaattcaggatctttttgcgcactgacaaaagcttcttccagctggcgcagagcaggcatcaggatttgtggcacgtacatgccgccaaactcaccaaaataggggttaagtaatgttgtcattgttcctttccttaatatgcgcgcagcgtctggaaaaccgaggccaaaagacgtgcgtctttgatgcccggttgcgactctacagcagaattaaaatcaagtccggcgcagccggtttgtgccgcttccacgcagttatctgcgcctaagccccccgccagcagaacgttgccaagcgattgaccatttaatagtgaccagtcaaaacgttgcccgcttccaccctggccgttgtctaaaacatatttatcaacgtgctgaaactcgcgggcgggcagggtttcaccgacgcttaatgctttccagatggcaacatgtgctggcagagcttcacgcagcgtatcgatatacagctgttcttcattaccatgcagttgcactgccgccagcgataacaccttagctttgtccaccacatcggcaatatcgtgattgcggaacacgccaacatactgcaacggtgccgcagccatcacttcctgcgcctgttcaacgttgacgcaacgcggtgatgtcgcaacaaaaatcaacccaccgtaaatcgcgcccgcgtcataagctgctttagcatcttgcccacgcgtcaggccacatactttattctcacccagcaacacccggcgcacggcggcgtgcaaatcgtcatgggccatcaacgccgaaccaatcagaaaaccgttagcgaagtggcttaactcgcgcacctgagcgtaagtattgatgccggattcgctgattaccgtcacgttgtgccccagtttcggcgcaagctcgcgggtacggttgagatcaatcgacaaatcacgcagatcgcggttgttgatgccaacgacctttgctcccaatgcaatggcgcgctcctgttcctcttcattactgacttcggtcagcacccccatctccagactgtgagcgacggcggcaagctggcgatattggtcgtcatccagtactgaaagcattaataagcaggcatcggcctggtaatagcgcgccagatagatctggtaagggtcgataatgaagtctttacataaaatcggctgcggggcgatttggctgacgatggggaggaaattaaagctcccctgaaaatatttctcatcagtcagcaccgaaattgccgaagcgtaatgtttataaatggcggcaatgcgtgctggatcgaaatcatcacggatcacgccttttgacggcgacgctttcttgcactccagaataaacgccgtgcgcgcaccctgtagcgcatcataaaaatgtcgcgtgctcggctgaacctcattctgaaaactggccagcggttgctgctgtttgcgggcttctacccaaatcgccttgtctgcgacgattttcgctaaaacggtttgcatcatttaccctcgtgccgccagtgcggtgactctgtcgtaagcggaaccactgcgcagtacctcaagaacggtttgcgcattggcttgcagatcttcatggccatgcaggcgcattaacatggcgacgttcgcagcgacggctgcttcatgggcggcgtcgcctttaccttgtaacaaacgtgttaaaatgtcacggttttcttccggtgttccgcctgccagttgctcctggtggtagggtgtcaggccaaagtcttctgcggtgagctgatagcttttaatttcgccgtcatgcagttcggcaacgattgtcggcgcgtgtaatgaaacttcatccatcccgccgctgtgcaccaccgccgcgcgttgataccccagcacgcgcaaggtttcggcaatcggcagcaccagttccggactataaacaccaattaacgccagcggcggatgcgccgggttaatcaatggccccagcacattgaacagggtgcgggttttcagttgctggcgaaccggcatcgcgtggcggaatccggtgtgatacttcggcgcaaagaggaaacatacacctaactcatccagcgcctggcgcgatttatcggcgttcatatcaagattaataccgaacgccgccagcagatcggacgaaccagatttactggagacgctacggttgccgtgtttcgccactttcagcccacaggccgcggcgacaaacgcactggcggtagaaatattgatactgttgctgccgtcaccgccagtaccgacgatatcagcaaacagataatccgggcgcgggaacggcgctgcgttttccagtagcgcggttgctgccccggcgatctcgttcgggtgctcaccgcgaattttcatgctcaccagcgccgccgccagttgttccggcttcagctcgccacgcaccaccgctgaaaacagctggtggctttcttgttggctaagcgtctgcgcctgatacagtttttccagaatcggttgcagcgtgttggctggctctagtttctgctgcgcccaggccagcgtttgttccagcaggcgagcgccctgggtggtgagaatggattccggatggaactggaatccacaaacgcgatccgcatcgtgacgtactgccatcaccatgccattaaaatgggcgttgatggttaaaccggccggaatgttactgccaaccagcgagtgataacgcgccaccggcagcgggtttgttaatccggcaaacatcgcctgaccgtcatgttcaatgctggaggctttaccgtggagaatttcgcccgcctgaccgacatagcccccgtaagcttcgacaatcgcctgatgtccgaggcaaatgccaataatgggcagcttgccacgcaagcgggtgaggagttccggcatacaaccggcttcgctcggcacaccggggccaggagaaagcatcagcaccggattgctcatggtcgccaggcgttcaattaaggtttgcgccggaatatggttgcggtaaatcaccacgttatgcccattgctgcgcaactgatctgccaggttgtacgtaaaagagtcgatattatcgagcagcagaatgtcagccatcagaaagtctcctgtgcatgatgcgcggtggcaatagcgcgcagtacagcgcgggctttgttacgggtttcgtcggcttccgactgcggaacagaatcaaggactacaccagcacccgcttgcacggtggcgataccgttttccaccagcgccgagcggatcacaatgcaggtgtcgagatcgccatgcgcggtgaaataacctaccgcgccgccgtagctgccgcggcgacgaccttccgcctcggcaattaactgcatagcgcgtactttcggcgcaccgcttaacgtccccatattcatacaggcgcgataagcgtgcagggcgtcaagatcgtgacgcagttcgccgactacgcgagagacgaggtgcatcacataggaataacggtcaactttggtgagatcggcgacgtagcggctgccgggggtgcaaatgcgtgccagatcattacgggcgagatcaaccagcatcagatgttcagacagctctttatgatcggtacgcatttccagttcaatacggctgtcgagatctctgtccagtgaaccatcggcgcgacgaccgcgtgggcgtgttccggcaatcgggtagatctcaatctggcggctggtggcatcatacttgagcgagctttccggcgacgcgccaaatagggtgaaatcattatcctgcataaaaaacatgtacgggctgggattactctttttcagcacgtaataggccgccagcggtgacgggcagggcagagagaaacggcgagatggcaccacctggaaaatttctccagcgcgaatcgctttttgcaacaaacgcactacgccaccgaactcttcatcgctctgattacattcacaacgcatatgcggcacggaaaccactggcagcggcggcgcggcttcggtcagttgctgacgtagttcgttcaggcgagcagtgagacgttgtttttcttcttcattcggagcaaacaggctggcctgaatacgggtgctttttttctgatggtcaatcaccatcagcgtttcagcgagataaaaacagaaatcagggcagttattttccgctgacagttgcggtaaatcttcaaatcccgccacaaggtcataagagaacaggccgccgaagaacatggcttctcgttcttccttcggtacattcaacagattctgcaataaacggaaagcgtcaaaaaccgaaagggagcataagcgggcgtcttcatccagcagtggactgacaggggggaagcgcagcacacggcagtttggtgattgttcactttccacacccgcaggcagggcgttatccagtagtgccaggagggcttcgccgttgccggaaagtgcctggattgtgacagtgtcacctaaagctgtaatgcgcagcgcactgtctaccagcagcaggctttttaaatcatctttgctgtcgatatctgcggattccagcagcagcgttgccggacgatccccacacaactggtgaaaaagcgcggtgggattgtcgcgataagcgccttcgcaggttagcagttcgagagtcggtttttgtgtttgcattgttattctctaattttgttcaaaaaaaagcccgctcattaggcgggctgggtatctgattgctttacgcatggtgaatacactgcccgtttcaggaagtgcgccaccaacctttcagtacgaaaattgctttcattgtcgataccctttttacgtgaacttgcgtactagttaactagttcgatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgagatgcgcgtcggcaccctggcgatcaccgaccatgacaccacagctgcaatcgcgccagcaagagaggaaatttcacgttcgggactggcgttgaatcttattcccggcgtggaaatttccacggtctgggaaaatcatgaaattcatattgtcgggctgaatattgatattactcatccgctaatgtgtgagttcctcgcgcagcagacagaacggcgcaatcagcgggcgcagctgattgccgaaagacttgaaaaagcgcaaatacctggggcgctggaaggcgcacaacgactggcgcagggcggcgcagtgacgcgcggtcattttgcgcgtttccttgttgagtgcggcaaagccagttcaatggcggatgtctttaaaaagtatctggcgcgcgggaaaaccggatacgttccgccacagtggtgtacaatagaacaagctattgatgtcattcatcattctggcggtaaggcggtgctagctcatcctgggcggtacaatcttagtgctaaatggctgaaaagattggttgcgcattttgccgaacaccacggtgacgcgatggaagtcgcgcagtgccagcaatcgcccaatgaacgtacccagctggcggcccttgcgcgtcagcatcatttatgggcatcacaaggatctgattttcatcagccatgcccgtggatcgaactgggtcgtaaactctggctgcccgcaggcgttgaaggcgtctggcagctatgggaacagccgcagaacaccacagagagggaattatgagccagtttttttatattcatcctgataacccacagcaacgtctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgttgataacgttgcgtttcgtttaatgaaaaacaacacgccgggcaactataccttcatcctgaaggggacgaaggaagtgccacgccgtctgttgcaggaaaaacgcaaaaccatcggtatgcgtgtgccttctaaccctatcgctcaggcgttacttgaagcattgggcgaaccgatgctttccacttcgctaatgctgccaggcagcgaatttaccgaatcggacccggaagaaattaaagatcgtctggaaaaacaggtagatttgattattcacggcggctatctcgggcagaaaccgacaacggttattgatcttaccgatgatacgccggtcgtggtgcgtgaaggcgtaggtgatgtgaagcctttcttataacaaattgcgttccacggatggaagactatggcagggaagtttcgctgcattttgctgttgatagcagggctgtttgtatcatctctaagttatgcagaaaacacggagatcccttcttatgaagaagggatctcgctctttgatgttgaagccactctgcaaccagatggggtgctcgacatcaaagaaaatattcattttcaggcgcgaaatcagcagattaagcacggcttttatcgtgatttaccacgactatggatgcagcctgatggggacgctgcactgctgaactatcatattgttggcgtcacccgtgatggtattcctgaaccctggcatcttgactggcatatcgggttaatgagtattgtcgtgggcgataaacaacgtttcttgcctcaaggcgactatcattatcaaattcattatcaggttaaaaatgctttcctgcgtgagggggattctgatctgctaatctggaacgtgaccggtaaccactggccgtttgaaatttataagacccgtttttctctccagttctctaatattgcgggtaatccatttagcgaaatcgatctttttaccggagaagagggcgacacatatcgtaatggccgcatccttgaggacggaagaattgaatcccgcgatccgttttatcgtgaagatttcacggtcctctaccgctggcctcacgctttacttagcaatgcctcggctccgcaaacgacgaatattttcagccatcttcttttaccctccacgtcatcgttgttaatttggtttccgtgtctgttcctggtttgtggatggttatatctctggaagcgcaggccgcaatttacgccggtagatgtgattgaaaccgatgtcattccgccagattacacgcccggcatgttacgtctcgatgcgaagctagtttacgacgataaaggtttttgtgccgatatcgtaaatctgattgtgaaaggaaaaattcatctggaagatcagtctgacaagaaccagcaaatcctgattcgtgttaatgaaggcgcgaccagaaataatgcggtattactgcccgcagagcagttattactggaagcgttatttcgtaaaggcgataaggtcgttcttacggggagacgcaacagagtcttacgcagggcatttttacggatgcagaaattttatctgccgcgtaaaaagtcttcgttttaccggtctgatacttttttgcaatggggtggactggcaatattggcggtcattctttacggtaacttgagtcctgtaggctgggcaggaatgagtctggtgggcgatatgtttattatgatctgctggattattccttttttattttgttcccttgagcttttgtttgcccgcgatgatgacaagccttgcgttaatcgtgtaatcatcactttgtttttaccactgatttgttcaggcgtggccttctattctctctacatcaatgtcggagatgtattcttttactggtatatgccagcgggttattttaccgctgtttgcctgaccggttatctcactggcatggggtatatttttctgccaaagtttacccaaactggacagcaacgttatgcccacggtgaagctatcgttaactatcttgcgcgtaaagaggcagcaacacacagtggacgtcggcggaaaggggaaacacggaaactggattacgcgttgctaggttgggctatatcggcaaatttggggagggaatgggcgttacgcattgccccttcgctttcttcggcgattcgcgctccagagattgcccgtaacggcgttttattctcattacagacgcacctaagttgcggggccaataccagtttgttggggcgaagttattccggtggtggtgctggcggcggcgcgggtggcggaggcggtggtggctggtaattaagctgatgttaatcgaaacaagctttaaccataaagatagtgtagtatgttgcgcctcaaagccaggccgataaacgtcgagtcgtttacttaaggcctgaagagttcaaacagactttactatcagtgagtcagatgtaagttctgactcactgttgcacaaaagcatatcagacgcctgggaaggcgacaccaaaaggaagctctatgagcgaaaagctacagaaagtgctggcgcgtgccggccacggttctcgccgtgaaatcgaatctattattgaagccggtcgtgtgagtgttgatggcaaaattgctaaactcggcgatcgtgttgaagttacccctggattgaaaatccgtatcgatggtcacctgatttcggtacgtgagtccgctgaacaaatttgtcgcgttctggcctattacaaaccggaaggtgagttgtgtacccgtaacgatccggaaggacgtccaacggtgtttgaccgtctgccaaaactgcgtggcgcacgctggattgccgtgggtcgcttggacgttaatacctgtggtctgctgctgttcaccaccgatggtgaactggcaaaccgtttaatgcacccaagccgtgaagttgaacgtgaatatgccgtgcgtgtatttggtcaggttgacgacgcgaaactgcgtgatttgagtcgtggcgtgcagttggaagatggtccggcagcttttaaaaccatcaagttcagcggcggcgaagggatcaaccagtggtacaacgtgactctgaccgaaggccgtaaccgtgaagttcgtcgtctgtgggaagcggttggtgtgcaggtgagccgcctgatccgtgttcgttacggtgatatcccactgccaaaaggtctgccacgcggtggctggacggagctggacctcgcccagactaactatctgcgcgaactggtggagctaccgccagaaaccagctctaaagtcgctgtagaaaaagaccgtcgtcgcatgaaggcgaatcagattcgtcgtgcggtgaaacgtcacagtcaggtgagcggcggtcgtcgttctggcggacgtaataataacggttaatcaaagtatgccggacgtcatatccggcatttttacagattaataatcgatccctatctgcgcttttacaccggcatcaaacgcatgtttgacggggcgtaattcacttaccgtatctgccagttcaagaatatcccgatgacaaccacgacccgtgataatcaccgtctgttgatgtggacgttcatttaacgcctgcaccacttcttccagtggcaaatagtcatacgccaccatatacgtcagttcatcaagcaaaaccatatccagtgaggaatcagcaagcatccgctttgcatgttgccagacttcgcggcaggcggcggtatcagactcgcggttttgtgtatcccaggtaaagcccgttgccatcacctgaaactcaacgccatgtggctccagcagattgcgttcgccattaggccaggtgcctttaataaactgcacgacgcctactttttttccgtgaccaactgcgcgtgttgccgtaccaaatgccgcggtggttttgccttttccattgccggtaaagacgatgataataccgcgttcatcctgggcctgggccacacgagcatctactttttctttcactcgctgctgacgctgttggtagcgttcatcactcattgggaaattcctggtttacggcccggttgggcgtcaaaggtcatgccggttttacggcggctgtcatcgcccatcagccagaggtagagcggcatgatatcagcgggtgttttaagtttctgtggatcttcggtcgggaaggcgctggcacgcattgcggtgcgcgtaccgcctgggttaatgcagttgacacgcaggcgctgctgatattcatcggccagtacctgcatcatcccttcggtggcaaatttcgacgctgcatatgcaccccagttggctcgtccctgacgtccaacgcttgatgaagtaaagaccagtgaaccggcgtccgatttgagtaataaaggaagcagtgcctgggtgagcataaaggtggcattaacgttgacctgcatgacgtcctgccagacctgcggattttgttcgctcattgggcaaacatcgccgagcaatccggcattatgcaaaacaccatccagacgcggataattaacggcaatgcgctgtgccagttgttggcaattttcggacgtgcaggtcagcaaatcgagaataaaccactgtggctgacgcccagtttcttcgtttatgtggctggctacctgacgtaatttttcttcattacggcccaacagaatcactgtcgcaccatagcgtgcatacgtcatcgcggcttcacgaccaataccatcgctggctcccgtcaccaggataatgcgatcattgagtaaatcttgttttggctggtaatgcatggctactcctcaacgacgttgtctgtcgcgctgccagtgtactttatgactttggggctttatgcctgaaacagaagggcatttcaatcagcctggggcgataacaccgcaaaatggatactttgtcatactttcgctgcaataacatctctgcgagacggcttaacatgcctgttgtaaactgtgagccaaagcgttgtttaaccaaggtggggactcgtggaattgttgtctgaatatggtttgtttttggcgaaaatcgttaccgttgtgctagcgattgcggcgattgccgccattattgtcaatgttgctcaacgtaataaacgccagcgtggcgagttacgggtcaacaatctcagcgaacagtataaggagatgaaagaagaactggccgcggcgctgatggactcacatcagcaaaaacagtggcacaaagcgcagaagaaaaagcataagcaagaagcgaaagcagcaaaagcgaaagccaaactgggcgaggtggcaactgacagtaaaccccgcgtctgggtgctggattttaaaggcagcatggacgcccatgaagtgaactcgctacgtgaagagataacggctgtactcgcagcattcaaaccgcaggatcaggttgtgctccgtctggaaagccctggtggcatggtgcatggttacgggctggcggcttcgcaactgcagcgtctgcgcgataaaaacattcctttaactgttacggtagacaaagtcgctgccagcggcggttacatgatggcctgtgtggcggacaaaattgtttccgcaccgtttgctattgtgggttccattggcgtggtggcgcaaatgcccaactttaaccgcttcctgaaaagcaaagatattgatatcgaactgcacactgccgggcagtataagcgcacgctgacgttgctgggtgaaaataccgaagaagggcgggagaaattccgcgaagagttgaacgaaacgcatcagttgtttaaagattttgtgaagcgtatgcgtccttctctggatattgaacaggtggcaacgggtgaacactggtacggacaacaggcggtagagaaaggcctggttgatgaaatcaacaccagtgatgaagttattcttagcctgatggaaggccgtgaagtggtcaatgtacgctatatgcagcgtaaacgactcattgaccgattcaccggcagcgcggcagagagcgccgatcgattgttgctacgctggtggcagcggggtcaaaagccattgatgtaaaagacaaacgcgaggctaagacctcgcgttttgctttaatcaaccagatgatatttttctgaaagcacatgggccaggtgtttgaacatattaaacaccgcggtgcttttggctgttggcaatccttgttcatctaaaaagtagtcgccggtaaataccagcacgccattacgctgcgtgacgccggtggcttcaatccctgcgagcgtatcctcatgctcacgaatgattttgttggcctctttcaacagcgtttcgcggtcgatgggttgtgtctctttgttcattatttactccttaaacaaggacattagtctacgccaggcatggcttgcagacaaatataccacgctggtggcaagagcgccttactggcaactttggattttgcatgctaataaagttgcgtatcggattttatcaggtacagtgtgacgctttcgtcaatctggcaatagatttgcttgacattcgaccaaaattccgtcgtgctatagcgcctgtaggccaagacctgttaactcagtcacctgaattttcgtgaacagagtcacgacaaggggttgatatccgcagagagcgagtccatatcggtaactcgttgccagtggaaggtttatcaacgtgcgacgcattcctggaagaatcaaattaggtaaggtgaatatgggtaaagctcttgtcatcgttgagtccccggcaaaagccaaaacgatcaacaagtatctgggtagtgactacgtggtgaaatccagcgtcggtcacatccgcgatttgccgaccagtggctcagctgccaaaaagagtgccgactctacctccaccaagacggctaaaaagcctaaaaaggatgaacgtggcgctctcgtcaaccgtatgggggttgacccgtggcacaattgggaggcgcactatgaagtgttgcctggtaaagagaaggtcgtctctgaactgaaacaactggctgaaaaagccgaccacatctatctcgcaaccgaccttgaccgcgaaggggaagccattgcatggcacctgcgggaagtgattgggggtgatgatgcgcgctatagccgagtggtgtttaacgaaattactaaaaacgcgatccgccaggcatttaacaaaccgggtgagctgaatattgatcgtgttaatgcccagcaggcgcgtcgctttatggaccgcgtggtggggtatatggtttcgccgctgctatggaaaaagatcgctcgtggcctgtctgccggtcgtgtgcagtcggtggcggttcgcctggtggtcgagcgtgagcgtgaaattaaagcgttcgtgccggaagagttctgggaagtcgatgccagcacgaccacgccatctggtgaagcgttggcgttacaggtgactcatcagaacgacaaaccgttccgtccggtcaacaaagaacaaactcaggctgcggtaagtctgctggaaaaagcgcgctacagcgtgctggaacgtgaagacaaaccgacaaccagtaaacctggcgctccttttattacctctacgctgcaacaagctgccagcacccgtcttggatttggcgtgaaaaaaaccatgatgatggcgcagcgtttgtatgaagcaggctatatcacttacatgcgtaccgactccactaacctgagtcaggacgcggtaaatatggttcgcggttatatcagcgataattttggtaagaaatatctgccggaaagtccgaatcagtacgccagcaaagaaaactcacaggaagcgcacgaagcgattcgtccttctgacgtcaatgtgatggcggaatcgctgaaggatatggaagcagatgcgcagaaactgtaccagttaatctggcgtcagttcgttgcctgccagatgaccccagcgaaatatgactccacgacgctgaccgttggtgcgggcgatttccgcctgaaagcacgcggtcgtattttgcgttttgatggctggacaaaagtgatgcctgcgttgcgtaaaggcgatgaagatcgcatcttaccagcagttaataaaggcgatgctctgacgctcgttgaacttacaccagcccagcactttaccaagccgccagcccgtttcagtgaagcatcgctggttaaagagctggaaaaacgcggtatcggtcgtccgtctacctatgcgtcgatcatttcgaccattcaggatcgtggctacgtgcgagtagaaaatcgtcgtttctatgcggaaaaaatgggcgaaatcgtcaccgatcgccttgaagaaaatttccgcgagttaatgaactacgactttaccgcgcagatggaaaacagcctcgaccaggtggcaaatcacgaagcagagtggaaagctgtactggatcacttcttctcggatttcacccagcagttagataaagctgaaaaagatccggaagagggtggtatgcgcccgaaccagatggttctgaccagcattgactgcccgacttgtggtcgcaaaatggggattcgcacagcgagcaccggggtattccttggctgttctggctatgcgctgccgccgaaagagcgttgcaaaaccaccattaacctggtgccggaaaacgaagtgctgaacgtgctggaaggcgaagatgctgaaaccaacgcgctgcgcgcaaaacgtcgttgcccgaaatgcggcacggcgatggacagctatctcatcgatccgaaacgtaagttgcatgtctgtggtaataacccaacctgcgacggttacgagatcgaagagggcgaattccgcattaaaggttatgacggcccgatcgttgagtgtgaaaaatgtggctctgaaatgcacctgaaaatggggcgtttcggtaaatacatggcctgcaccaacgaagagtgtaaaaacacacgtaagattttacgtaacggcgaagtggcaccaccgaaagaagatccggtgccattacctgagctgccgtgcgaaaaatcagatgcttatttcgtgctgcgtgacggtgctgccggtgtgttcctggctgccaacactttcccgaaatcgcgtgaaacgcgtgcgccactggtggaagagctttatcgcttccgcgaccgtctgccggaaaaactgcgttatctggccgatgcgccacagcaggatccggaaggtaataagaccatggttcgctttagccgtaaaaccaaacagcaatatgtctcttcggaaaaagacggaaaggcgactggctggtcagcattttatgttgatggcaaatgggttgaaggaaaaaaataacctttaattctgtcaggtttttataaacaaagggtcgcgaaagcggcccttttttattgcatattattttttcttcacacctatacactaaggctataaatgatatagtggttatagttagcaccttttttattattaaatcgtattagtcacccgccaggtgtgacgaaaaaacgatgttctgatggcgtctaagtggatggtttaacatgaaattacaacaacttcgctatattgttgaggtggtcaatcataacctgaatgtctcatcaacagcggaaggactttacacatcacaacccgggatcagtaaacaagtcagaatgctggaagacgagctaggcattcaaattttttcccgaagcggcaagcacctgacgcaggtaacgccagcagggcaagaaataattcgtatcgctcgcgaagtcctgtcgaaagtcgatgccataaaatcggttgccggagagcacacctggccggataaaggttcactgtatatcgccaccacgcatacccaggcacgctacgcattaccaaacgtcatcaaaggctttattgagcgttatcctcgcgtttctttgcatatgcaccagggctcgccgacacaaattgctgatgccgtctctaaaggcaatgctgatttcgctatcgccacagaagcgctgcatctgtatgaagatttagtgatgttaccgtgctaccactggaatcgggctattgtagtcactccggatcacccgctggcaggcaaaaaagccattaccattgaagaactggcgcaatatccgttggtgacatataccttcggctttaccggacgttcagaactggatactgcctttaatcgcgcagggttaacgccgcgtatcgttttcacggcaacggatgctgacgtcattaaaacttacgtccggttagggctgggggtaggggtcattgccagcatggcggtggatccggtcgccgatcccgaccttgtgcgtgttgatgctcacgatatcttcagccacagtacaaccaaaattggttttcgccgtagtactttcttgcgcagttatatgtatgatttcattcagcgttttgcaccgcatttaacgcgtgatgtcgttgatgcggctgtcgcattgcgctctaatgaagaaattgaggtcatgtttaaagatataaaactgccggaaaaataatttcttgcgttattttcggcaccttttatgtagcgaaggtgccggaatatattctcttttgttacttatttctataccgtgcacaatatttttatccctcatatttatagggtaaattacctgtaaagtagtgtctaattacccgcctcgcaaactccagttttcaaatatctatttcaggtcaaaagattgaattattcactggagacgattcgtaaattcgctggatttttgactaaagtttctttaggatttgtctcatcgtatgattaattacaccaatcgttcaacgtcttgctgataagtgatggcgattatatgaggttagcaatgccttctggaaatcaggaaccccgccgcgatcctgaattaaaacgtaaagcctggctggcggtttttcttggttctgcacttttctgggtggttgtcgcactgctgatttggaaagtgtggggataactatggtcggtcaggagcaactggagtcgtcaccattatgccagcatagtgacaatgaaacagaaacgaaacgggaatgttccgtcgttattccagacgactggcaactaacatcgcagcagcaagcctttatagaactgtttgctgaagatgatcagccgaaacaataattatcatcattcttattacccatttttaatgaattaaagggcttttaatacaccgcagcaataacagcttgagttatctcaacacaaaataataaccgttaagggtgtagcctatgatcaacacaaatatgaaatattggtcctggatgggcgcgttttctctgtcgatgctcttctgggccgaactcctctggatcattactcactgatccttgaccccgctgcggcggggttgtcatttgctttgccacaaggtttctcctcttttatcaatttgggttgttatcaaatcgttacgcgatgtttgtgttatctttaatattcaccctgaagagaatcagggcttcgcaaccctgtcattaaggaggagctatgtcgtcaaccctacgagaagccagtaaggacacgttgcaggccaaagataaaacttaccactactacagcctgccgcttgctgctaaatcactgggcgatatcacccgtctacccaagtcactcaaagttttgctcgaaaacctgctgcgctggcaggatggtaactcggttaccgaagaggatatccacgcgctggcaggatggctgaaaaatgcccatgctgaccgtgaaattgcctaccgcccggcaagggtgctgatgcaggactttaccggcgtacctgccgttgttgatctggcggcaatgcgcgaagcggttaaacgcctcggcggcgatactgcaaaggttaacccgctctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaagcgttcagtcggtttagcgtcgtgccgccaggcacaggcatttgccatcaggttaacctcgaatatctcggcaaagcagtgtggagtgaattgcaggacggtgaatggattgcttatccggatacactcgttggtactgactcgcacaccaccatgatcaacggccttggcgtgctggggtggggcgttggtgggatcgaagcagaagccgcaatgttaggccagccggtttccatgcttatcccggatgtagtgggcttcaaacttaccggaaaattacgtgaaggtattaccgccacagacctggttctcactgttacccaaatgctgcgcaaacatggcgtggtggggaaattcgtcgaattttatggtgatggtctggattcactaccgttggcggatcgcgccaccattgccaatatgtcgccagaatatggtgccacctgtggcttcttcccaatcgatgctgtaaccctcgattacatgcgtttaagcgggcgcagcgaagatcaggtcgagttggtcgaaaaatatgccaaagcgcagggcatgtggcgtaacccgggcgatgaaccaatttttaccagtacgttagaactggatatgaatgacgttgaagcgagcctggcagggcctaaacgcccacaggatcgcgttgcactgcccgatgtaccaaaagcatttgccgccagtaacgaactggaagtgaatgccacgcataaagatcgccagccggtcgattatgttatgaacggacatcagtatcagttacctgatggcgctgtggtcattgctgcgataacctcgtgcaccaacacctctaacccaagtgtgctgatggccgcaggcttgctggcgaaaaaagccgtaactctgggcctcaagcggcaaccatgggtcaaagcgtcgctggcaccgggttcgaaagtcgtttctgattatctggcaaaagcgaaactgacaccgtatctcgacgaactggggtttaaccttgtgggatacggttgtaccacctgtattggtaactctgggccgctgcccgatcctatcgaaacggcaatcaaaaaaagcgatttaaccgtcggtgcggtgctgtccggcaaccgtaactttgaaggccgtatccatccgctggttaaaactaactggctggcctcgccgccgctggtggttgcctatgcgctggcgggaaatatgaatatcaacctggcttctgagcctatcggccatgatcgcaaaggcgatccggtttatctgaaagatatctggccatcggcacaagaaattgcccgtgcggtagaacaagtctccacagaaatgttccgcaaagagtacgcagaagtttttgaaggcacagcagagtggaagggaattaacgtcacacgatccgatacctacggttggcaggaggactcaacctatattcgcttatcgcctttctttgatgaaatgcaggcaacaccagcaccagtggaagatattcacggtgcgcggatcctcgcaatgctgggggattcagtcaccactgaccatatctctccggcgggcagtattaagcccgacagcccagcgggtcgatatctacaaggtcggggtgttgagcgaaaagactttaactcctacggttcgcggcgtggtaaccatgaagtgatgatgcgcggcaccttcgccaatattcgcatccgtaatgaaatggtgcctggcgttgaaggggggatgacgcggcatttacctgacagcgacgtagtctctatttatgatgctgcgatgcgctataagcaggagcaaacgccgctggcggtgattgccgggaaagagtatggatcaggctccagtcgtgactgggcggcaaaaggtccgcgtctgcttggtattcgtgtggtgattgccgaatcgtttgaacgaattcaccgttcgaatttaattggcatgggcatcctgccgctggaatttccgcaaggcgtaacgcgtaaaacgttagggctaaccggggaagagaagattgatattggcgatctgcaaaacctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaacaactatttgcttgccggttattttgcttccggcaagcaaatgaattacacaatgcaagagggttatttgttcagcaaatggcccattttctcggctttggtatcgagataatgttcgttattggggttacgacctacaatcaatggtacgcgttcaacaatattaatccctgcttcggtcagaatttcgacttttttcgggttattggttaacaagcggacttcattgacgccaaggagtttgaacatatcagcgcaaagagtgaagtcgcgctcatcagcggcgaagcctaactggtggttagcctctacggtatcgtaaccttgatcctgcagtgcgtaagcgcggattttattcagcagaccaatgttacgaccttcctgacggtgatacagcaaaataccacggccttcctcggcaatttgcgtcaatgccgcttcgagctggaagccacaatcgcagcgcaagctgaacagggcgtcaccggtcagacattcggaatggacgcgcgcaagtaccggggtatgcccggaaatatcgccatagactagcgcgacatgatcgtgtccggttgccagttcttcaaatcccaccatcaggaaatcgccccatggggttggcagtttggcttctgccacacgtttaagctgcatgaaattctccagataatgctggttctgtattggcttattttgccataacgagaaggggttcacctaatcacgacgcgtcgatcgttcacggaatggcacaaatctgtcaatttttcctggaactggcgttttcagttatgattgtgggacttatcaaaaaggagaggccatgcgttcgattgccagacgtaccgcagtgggagctgcactattgcttgtcatgccagtagccgtatggatttctggctggcgttggcaacctggagaacaaagttggctactaaaagcggctttttgggttactgaaactgtcacccagccctggggcgtcattacacatttgattttattcggctggtttctctggtgtctgcgttttcgcattaaggctgcctttgtattatttgccattctggcggccgcaatccttgtgggacaaggcgttaaatcctggatcaaagacaaagtccaggaaccacgaccttttgttatctggctggaaaaaacacatcatattccggttgatgagttctacactttaaagcgagcagaacgcggaaatctagtgaaagaacagttggctgaagagaaaaatatcccacaatatttgcgttcacactggcagaaagagacggggtttgcctttccttccggtcacacgatgtttgctgccagttgggcactgctggccgttggtttgctgtggccgcgtcggcgaacgttaaccattgctatcttgctggtctgggcaacgggagtcatgggaagccgcctgctgctcgggatgcattggccacgcgatctggtagtagctacgttgatttcgtgggcgctggtggcggtggcaacgtggcttgcgcaacgaatttgtgggccattaacaccacctgcggaagaaaatcgcgaaatagcgcaacgagaacaagaaagttaacgctggttgattttccgaatttagcccttaaatcatcaacaatgcgtgtggatgccatttcgcagacggcgcgaaaatggtactttaaagggctattgcggtaagttgaccataatttattcgctctaaccacataacgggaagtaatgtgaaatatttactcattttcttactggtgttagcgatcttcgtgatttcggtcacgttgggtgcgcagaacgatcaacaggtgacgtttaattatctgttagcgcaaggggagtaccgtatttccacattgctggcggtattgtttgctgcggggtttgctatcggttggttgatttgtggcctgttctggctgcgagttcgtgtttccctggcgcgcgctgaacgtaaaataaagcgactggaaaaccagctttcacccgcgactgacgtggctgtagtgccgcactcgtcagcggcgaaggaataactttctatgctggagttgttgtttctgcttttgcctgtagccgctgcctatggctggtatatgggccgcagaagtgcgcaacaaaacaagcaagatgaagccaaccgcttgtcgcgtgattacgtagcgggggttaacttcctgcttagtaatcaacaggataaagcggtagacctgtttctcgatatgcttaaagaggatacaggcaccgttgaagcccaccttacgctcggaaacctgttccgttcgcgtggcgaagttgatcgcgctattcgcatccatcagaccctaatggaaagcgcctcgctgacctatgaacagcgtctgttggcgattcaacaactggggcgtgattacatggccgccgggttatatgaccgcgcggaagacatgttcaatcagctgaccgatgaaactgacttccgcattggcgcgctgcaacagttgctacaaatctaccaggctaccagtgagtggcagaaagcaattgatgttgccgaacgcctggtgaagctgggtaaagataaacagcgcgtcgaaattgcccatttctactgtgagttagccctgcagcatatggccagcgacgatctcgatcgtgccatgaccttgctaaaaaaaggggcggcggcagataaaaacagcgcccgcgtatccataatgatgggacgcgtgtttatggcgaaaggagaatacgccaaagccgtcgaaagtctgcaacgcgtgatatcccaggacagagaactggtcagcgaaacgctggaaatgttgcaaacctgctatcagcagttgggtaaaactgccgaatgggcagaattcctgcagcgtgcggtggaagagaacaccggtgccgatgctgaattgatgcttgctgatatcatcgaagcgcgcgacggtagtgaggccgcacaggtctatattacgcgccagcttcagcgtcatccgaccatgcgtgtgttccataagttaatggattaccacttaaatgaagcggaagaagggcgtgccaaagagagcctgatggtgctgcgtgacatggttggcgagaaggtacgtagtaagcctcgttatcgttgccagaaatgtggttttaccgcatacaccctctactggcattgtccgtcttgtcgggcctggtcaaccattaaaccgattcgcggtcttgatggcctgtaatttttaaaaaaaatccgactttagttacaacatactaattattaatgttccattgtgctccggcaacgacggcgcagaaaaagcctgccaggggagaaatcgcaactgttaattttttatttccacgggtagaatgctcgccgtttacctgtttcgcgccacttccggtgcccatcatcaagaaggtctggtcatgacgttaactgcttcatcttcttcccgcgctgttacgaattctcctgtggttgttgcccttgattatcataatcgtgatgacgcgctggcctttgtcgacaagatcgacccacgcgattgtcgtctgaaggtcggcaaagagatgtttacattgtttgggccacagtttgtgcgcgaacttcaacagcgtggttttgatatctttcttgacctgaaattccacgatatccccaacactgcagcgcacgctgtcgctgctgcagctgacttaggcgtgtggatggtgaatgttcatgcctctggtggggcgcgtatgatgaccgcagcgcgtgaggcactggttccgtttggcaaagatgcaccgcttttgattgctgtgacagtgttgaccagcatggaagccagcgacctggtcgatcttggcatgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgaagctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatgatgagtgattccaacagccgtctggtctactcaacggaaaccggacgtattgatgagcccaaagcggcccctgtacgccctaaaggcgacggtgtggtgcgtattcagcgtcagaccagtggacgtaaaggtaagggcgtttgcctgattaccggtgtcgatctcgatgatgccgaactgacaaaacttgcagcggaactgaagaaaaaatgcggctgcggcggagcagttaaagatggagttattgaaatccagggcgataagcgtgatttattaaaatcactacttgaagcgaaagggatgaaggtaaaactcgcaggcggttaacataaaaagccacggatatatccgtggctttcgaatattttactgtgcgtattattcagttatttcgtactgaacagaatcaagcgtattataattgcgagtcgataatcgacatttatttacgattatttaccgacctggtgaccaataacacctccgacagctgcaccacctaatgtacccaacgtactgccatcggtcagtactgcaccgcctaatgcccctgcacccgcgccgattgcggtgttgcggtcccgtttagaccagttagaacaggcactcagagacattgccaaagtaattgccagaacagccgcggtcatttttttgctcgttacaaacataatactctctcctgaatttatgattcacggaagtaagctctctataactataatagctaagaataagtctggtgaaattattccgtgaaatctgctcgcgcgcagggttatatcacgcaggtgataatgacttcctgttatatcgctgataataattttatatcttgagagtgttaataacaggtaaatagtcttaattatcaaccaggaatcatcttagagcggatgatttgccaaactgcaaatcatccgtagagaagggaaatggttaaatgtcaacgacgtgaatggtgagtttactgtgctcaagatgcatcagatcgctggcgcgtattttcgaatcggtaatcacgcgattgaatcgctcaacgggaccgatggagtatgaatgtacagcaccaaatttcgagctgtcagtcaggactatcgcttcgcactctttttccagcacggcattgaccacatcggtacgcatcatatcgcgaccggtaaatccagtttcaggttgccagccatcaataccaataaatgctttgctgaaatgcacctgttggatgcactggcgtgtcaaagggccaaccatactttcgctttttttctgatacacgccaccgagcaaaataacttcacaaggcgcgtctttcagcaaatgcgcgatgtagctgctgaccgtgatgatagtgacatttttcttctgctcgcccagagtccgggcgagtagggcattgctgctgccattttcgataaagatggtttcgcccggttgaaccagcgacgcggcaaactcggcgagttcacgcttcagcgtatagttgctcatcatacgggtttcgacgtcatcactatcaagcgaaacagcaaagccatgtgcacggcggaggtaactcagtttttcgagtgtgttgagatcctggcgaatggtaacttcagaaactccagtggcttttgccagatcggttacgctaacctgaccctggtcaatgaccatctgtagaatagtttgttgtcgggaattcatcgctgtaattcttataacgttataatacttaataaaaaaatactgacgcgccgggcatcctcaaataggaaaacctgaaggcacgattgttaaatctcccacggtgccttcgggatgtctggcgtagattcagcaacctggcgcaagagttctgctttaagtatctcgagattatggatcgcagagtggtaatcgcctgccacaaggatatctaacacaatatcaatacgttcggcaacgcgctgggcatcaaattcagacatcaaggacatccttatagcaaaagggggaaaatgaataatgcaaaaattgccgctaaaagagaagtgtttaacagcaacggctaattatcatccaggaatacgatatataatgacgggatatagcgctaagtatatatattcatctacttatgcgcgcttcagatagcgtttataccagcgttcgaaggcgacggcgggcatcggtttggcaaacaaaaatccttgccgctcattgatcccgttcttggttaaaaaagcatcttcctttgcactctctacaccttcggcgatcacctgaagattcaatgcctgggccacagcgacgatcgcccggaccagtgactgcgagacaggttgtttgtgaatatctcgaacaaaaacctggtcaagtttgatggcatcgatcggaaagcgcgccagttgcgaaagtgaagagtagccggtaccaaaatcatccagatgcacttgcgcacctagttggctaaattgttgaataacagacagtgccagttcatcattctcaatcagacaactctctgtcagttcaacatctatagggcagtattcaaaattgagttcctggagaacctgtttcagggcggtgaaaatggtttgatcggcgagctgacgtgcagaaatatttaccgccactcgcaggtttatgcctttatcccgccactttgccacctggcgtacgacatcgagaatcacccaacggcctaaaggcacaattagccctgactcttcggcgtaggaaatgaagtccaacggtggaatcaacccacgttcaggtgactgccaacgtactagtgcttccagactgcgcacttcgccacgccaggtgattttcggttgatagtgaataaccaactgatcgttttccagtgctttacgcaagttggtatccagccagagatattcaaatacccgttgattcatttctggggtaaaaacgcaaaattgtcctcgtccgccttccttcgctgtgtacattgctgtgtcggcgtgacgaataatagccgtgctgtctgaaccatgttcgggagagagtgcaatacctactgaacagctggtataaacttcaattaaaccaatgcgaaaggggagccgtaagcgggtcaaaattcgtgatgccattgcttccagcgcgctttgtgaggtgttggatgccagtaccagaaactcatccccacctggacgcgccaacacctggtcatgttcgagacagcttaaaatagccaatgacacgtcgcgtaataactggtcaccaaacaaatgcccataggcgtcgttgacctttttgaaattatccaaatcaagatacacaaccccaactttattgttatctgcatgattaatagcgtgatcgattaaatcctgcattgcgttacgattcggcagtccggtgatactgtcggtatttgccagaatacgcagtcgctcctgagcgcggcgctcttcggtaatgtcggtgccggaacagattaaaaaaatctcgtttttgccactgccgctgtggacaaatttattgcgaaacagaaacagccgctggcctttacatgttggtatccacagttcgacttcatatgcattgccgcttcgaaaaaatacacggttattgcgcctggatgccgcagcttcacgacggctcataaacagtttaaacacgctttgcccaatgacgtcgtgttctttcaaccctgtgtaatcttcacataaccgattgaagcgttggatattcccccggctgtcgagaatcactattgcggaatgtgcttcagaaactacctgctcagcaaaggaaagcccgtgtgataaatcacgagcaaccgccggtgtgtcatgccatgcagacgcgttgccagcccattcccgtttattgatttttcgtcctaccagatgcacagaaagatcgctttcatcgacggtcagactcatcatcaggctggaggtgatgaccgtcatttccctgatgcgagcagcctgttcggcagataactgcaatgtacgatcaggttctgtggtttcggtggtagaaaagcgcaaaacatcgctgctttccgtcaaccgccagtatggattgtgcgatccgagaaagttgtacaacgttgtggactccctaacggttttcatgatgcatatcctccggttaacagcggagtccgcggttaaataaaaggaacaacatgacttacatgaaattaacggcggctaaacgcattgttttttttatatatttatttgtaatccagttttggaaaaacgccagttttcaaacgaaagtcagttaaaaaatctgcctggatataacgaaggtagagcggggaaataaacggcccatccatgaggaatgggccgtgaaaggagattacgcgaccgggcgcgcaataatgctgcgggtttccatgcggacttcggcaatagtgacgtcaataacgtcagtcactttgtaaaccgtttcacctttaatttgtacagtgccgttttcctggctgcaaaccagttcatcgcgcacagcgtgtaagaaaggtgccggaataaaggcgatagcgccgttatcaaccaaacgaacacgcatgccgccacggctgatatcgacaatttccgctgcgaaacgggtgtcggtcccggctttgtctttcaggaagcgtgcgtataaccagtcaccaacatcacgttctgccatccggttgagacggcgacgctcggccatttggacagtgatttcatcctgtgggcgcgtcgcagtttcgcctttgataaccgctttcagcagacggtggttgatcatgtcgccatatttacggatcggcgaagtccaggtggcgtatgcttccagaccgaggccaaagtgaggaccgggttcagtgctaatttcagcaaatgactggaagcgacgaatgcggctgtcgaggaaaccagttggttgcgcgtccagttcacgacgcagtttgcagaaaccgtccagcgtgagcacttcttcggcatcgacatgcagaccgtgcgttttcagcaacgctgccagcgcgtcggcattcgccggatcaaagcccatatgcacgttatagatgccaaaaccgagcttatcgcgcagtacgcgggccgcacaaatgttagcggcaatcatcgcttcttcgacgatacggttggcaatgcgacgaggctcggcgacgatatccagcacttcacctttttcaccgagaataaagcggtaatccgggcgatctttaaacaccagtgcgtggttatgacgccactcgccgcggcgttggcaaatttgcgctagcaaacggacttgttcggcaattgcttcactttcaggctgccagtcaccggtattttccagccagtcagaaacctggtcatacaccagctttgctttggattcgatggtggcggcaaagaattcgatattatcttcaatggtgccatcagcggagagcgtcatgcggcatgccagtaccgggcggacttcattggcgcgcagtgagcagagatcgtcagaaagctcgcgaggcagcatagggatgttgaagccaggcagatagttggtgaatgcgcgaattttcgcggctttgtccagcttgctgccttcagcaatccacgcggttggatcggcaatcgccacaatcagctgaagtttgtcatccggcaacgccttagcgaaaagggcgtcatccatatcttctgtgctggcactgtcgatggtgacaaaatccagcgcggtcagatcttcacgaaccagaccttcatcgagcatttcggtagcgacgccgtctggtgcttctttttccagattatggcgtgcaagggtaacccaccacggtacaaagtgatcgtcaccaaaagtgatgtattgtgtcagttctgcatagaaagaacgatcgcctttcagcggatgacggcgcatttcggcaaccgcccagtcgccttctttaaactcgtggttcaggccacgggctgcgcggcaaggaatggcgtcttttaagagtggatgatcaggaacgatggccagacggtcatttttgccctgaaccttacccacgaaacgagtcaggaacggttcaaccagttcttctggctctgcggattcacgttctttttcactgtggatcaccgcgataattcggtcgccatgcatgacttttttcatctgcggcggcggaatgaaataacttttttgcgcgtcgacttccaggaagccaaagcctttttctgtggcttttaccaccccttcagcgcgtggcgtctgggaatgcagttgctgtttaagctgcgctagcagcgggttgtcctgaaacataattgtctattttggtggccattagagcggctgacagttttacgcgaatctgtctgacgcggcaaggttaatatgtctcacccaacgcgatttttaagcgatttatccagccacacagcccgctccataccagcagattaataatctgcgttgatgatttttcgtgttcgagtaaagggctgaactgggcggcgctaaagcgatcgggtgctcgggtcagccattgtatcgcctgaacggtagcgcgctcaacagaatgacggtcagcccattggttaatttcattttcgcccttgcgcataagggtgctgatttttttatattcatttgatgaatccatacaggtggcaaaacaagcaggactgccatttatacgcgcgcataacaacgccgcaagctgattatccggctgtgtattgccccgtgtgctgtttaacaacttttcgagaagggaaagtgaaatagggtggagagagagtatttcggccagttggcaaagttctgcagttgaactttttgtgtgctcttcaggtagtttttccacctcatagctgcttcgccagcgtaatgattcatcagcaaacagtgacgcgtcggcgtagttttgtatctccagcccgggtaaccagcgtaccggatgcccgagataagcctgaaatgtcgcaattgtccgcgcctgaaagccaataaaaccaatgatttggctaatgatcacacagtcccaggcagtaagaccgacgtcattcagatgctggcgcgatcggttgtcgataatagaaggcgagctagccagttggcgggcatattgcgtgatttgtgccaaccgatgattactttccctggtggaatcaggcccggggagcggcgtaagtcgcgccgaatagtagttacataaccgctggacgccgcaaacctgagcaaccgtcagggccgtcgacaagcgttcataagcggtgaaggtctgtgaacgggtcacggtaagctggtcagggaacaaatccactgcaagaacacgcgcagggtccagccatgaaaggaagggggccagcgtttctttttcaaggatcacgtcgagtagaaagggatcgctgacctttgcggcttccgggaccagaggcagaacgtcatactccgtagtactggattgcgtttcatgataccagtggcttttgccggtgatgtggcgttgttccatgggcgctccttggtcgtaaaggaaatcgttatcctgacgcaaggcgggaaggggagaaagacggatcggcgataacaaatatcagaaaggtataacagagataacgggcggcagaacgccgcccatctttaccaacagaacgattatttcagttcgagttcgttcattgcagcaatgctgaaaccgccgtcaacgtggaccacttcaccggagataccggcagagagatcggagcacaggaatgccgcagagttacccacatcttcaatagtaacggtacggcgaatcggggtaacggcttcgcaatgagccagcattttgcggaagtctttgataccggaggccgccagagtacggatcggaccagcagagatggcgttaacacgcacaccttccggacccatcgcgttcgccatatagcgcacgttcgcttccagagacgcttttgccagacccataacgttgtagttcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgggtaacggcgttaacatagtcaccatccagctgatcgccaggtgcaaaaccaatagagtgtacgaaaccgtcaaatttcggccaaactttccccagttcagcgaacatggtgtcgatgctggcatcttctgcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggatagtttgctggcaacaccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgagtagctatagttgccaggtccgaccggagcaggctgcggcagggggggcgcttttcccctcaccctaaccctctccccagaggggcgaggggaccgtattgtgcaaatattgttaccccagcaacaaacaggctcatacagcccctaaccctttcatggcgatggctgggacggttcagaccttgccgaatattctccagcaccgtctccatgttttcaccacaacagctattcggctcggtctgccccctcgctctttcagggagagggtgaccggcggttcagttcctgcagaatattctccagcaccgtctcctcattacaatcaatctcgttattccagaaacgcagcacggtccagccctgcgactcaagccagctagtgcgcctggaatcataggcaactgctaaatcatgctgcccaccatccagctcaacgactacacgcgccgagcagcaagcaaaatcgagaatgtagctccccactggatgttgacggcgaaatttgaaatcactaaaacgtcggctgcgaagatatcgccagagctttcgttcctgcaaagtgagattgcgtcttaaatcacgcgcatttgatttaattttatctatcacctcattctgacaagatttaatcttttgtcagaatgaggtgaataatctggaaggaggattcagaaaattagcgatctttacgccacgcatccgccgtcaatgcctcgccaaaatgaccggcaatcagccgtttggtgagttcatgcagcggcgatgccagcacatccgcggtgctgcctcgctcgacaacctcgccctgatgcatcaccagcacctggtcgctaatgtgcttcatcattccgatatgctgggtaacataaatatacgaaatgccctgtttttcctgtaattccagcatcagattaatcaactgcgaacgcatcgacatatccagtgaagcgagggcttcatcggcaataatgacttttgggcgcaatatcagcgcgcgcgccagacccagacgctgtttttgtccgggtgccaacatatgcggatagtaactgacgtgatccggtagcagcccaaccatacgcatcgtttcaataatctgtttgcgacgctgttccggttccaggtcggtgttcaggcgcagtggaaaatccagaatttgcgagatacgttgacggggattcaacgaggtcgaaggatcctgaaaaatcatgcgaatacgctgactgcggaaggaataatcgccaaaatgcagtggatgatcgtcaatcaataactcgccgctggtaggctctatcattcccgccagcatttttgccagcgtggatttacccgaaccattctcgccaataatcgccagtgtctggccttcacgtagcgtaaagctcaagggttttaccgcttctacggtctgacgacgaaaccagccggtccggtagcggaacgttttacttaaattacgcacttcaagcagcgtttcgatcatctcactctttctccatgttcagcgggaaatgacaggcatagagatgatttttcgcccccgtcaaacgtggcgtcacaatgcattctcgttgtgcatacgggcaacgtggccccagacgacaaccaatcggtaactgttccagcagtgggatagcgccgggcagcgtattgaggcgacttttatgcggcatcgcgctgccgaagtctggtatcgcgcggatcagcgcctgggtataaggatgatgtggcatcgtcaccaactccttactcggcgcggtttccactgtttgaccgcagtaaagcacgttaattttatccgcccattggctaagcatttgtaagtcatggctgataagcaaaatagtggtattgctgttttggttgagacgcgtcagcaggcgaaagatttgcgcctgggttgttggctccattgagttggtcggttcgtcagcaatcagcagacgcggttgattcgccagtgcaatggctatcatcactttctgacattcaccttcggtcaactcatagggaaaactgcgcatcgcatctttgtgatctttaatccccacgcggtgcagcagttcaatggcacggcgtttgcgccagccaaaacgctgccaccaacggcctttataggtccaggctgggatgttttgcatcaactggcggcccacacgttctgaagggtcaagacacgactgcggttcctggaaaatcatcgacacgttatggccaaccagtttgcgccgttcgcgtgcggagagacgcagcaaatcgatatcatcaaaacgcatacggtcagcagtaacacgccagttatctttattcaccccacaaatcgctttcgcaatcaaactcttgccggaaccggattcaccaacaagaccgcggatttcaccttcggttaaggtcatacttacccggtcgacggctttaacccactcatcaccggttttaaattcaatggtcaggttacgaatatcgagtaatggcattattccacccccgcaataatcgcacgacgaacgccatcgccaaggaggttaaccaacaacacgctaatcataattgccgcacctggcagcatgacagtccacggggcgacataaatcagttccagcgcatcaccgagcatcgctccccattcaggcgaggggagttgtgcgccgagatcgagaaagcccagcgcggcgatatcgagaattgccatcgacagtgcgcgggtgatctcggtgaccagcccggcggtgatgtttggcatcacagcaaaccagagaatattcagcgttgatgcgccatccagacgggcggcgataacgtactctttttccagttcgtcatgcaccatgctgtaaatcgaacgtaccatacgcggcagcaatgccagccagacagcaaacatagcgtgggacaaactcggtccggcaaacgctacaacgataattgccaacagcagcgaagggatcgccagtaaggtatccagaatatggttaagcaccgctgagcggaggccgtgtgtcgccccggcgaaggtgcccagtaccaggccacagatcgtcgcggcaagcgtcaccacaaatgcgccacccacggttggcgcagctccgctcagtaaacggcttaaaacatcgcgtccgaggtcgtcagtccccaggaagaaagaaacttcgccatagcgcgaccatgacggcggcaataattgataaccgagaaattgctggtcgatgccgtaaggcgcaaaccagccgccaaaaatacacagtacagccagccccgcgcagccgtacaggccgaccatcgcagaggcgtcactataaaatttgcgccaggcggtacgcagcgtgcccggcgggcgcttttcgctgtatacgctatcgtaaggcataccattccttatgtttcagagggttagccatggcacccaaaatatcagaaatcacgttaacaataatgaccagtgagccacacaccatcactccggcggaaatggctgcgtaatcctgctggcggatggcgttaattaaccagcgccctaaacccggccagctaaaaaccatttcggtgatcatcgccagcgtcagcatggtggaaaactgtaagcccaggcgaggaataaccggcggtaacgcgttatgcagaacgtggcgacgcaaaatagtaaagcgcgacaaaccgcgggtcgccgccgcttttacatagttctggtcatacacttcgatagtgctgatacgcatcaggcggatcacttcagttgttggcgcaaccgacagggtgatcacgggcaatatcatatggcggattgcgctcatgatcatttcatcccgccatggtgagtccgaaagccaggcatcaatcaacgcaaaaccggtaatcggtttcacttcgtagagcagatcgaaacgccctgaaacgggcaaccaacctagcgtgagtgaacaaaacagcgtcaacagaagcgccagccagaacaccgggattgaaaagcccagtaaggcgatggcgttgatcaagttatcctgccacttatggcgcgtaatcccggcaatcatccccacggggatgccaacaatcagcgcaaaaccgaaggcgaggatgcacagttccatcgtcgccgggaagacctcttttaactgttcggcaatcggttgaccgttaatgctggaaacaccaaaatcccagtggatcaggccgttaaaccagaacacccaggcattccacagtgacgcgccttgtaacggcgcatgaggggtgaaatagctcaagctgaagccaacgaaggtcagcaggaacaaggtgacaatcaataacaaaatgcggcgtaaggtgaagataatcatggttttttcacctcatcctgtttctcgcgatacaccccagcaaaggaggcgttaccaaacgggctaagtaccagacctttgatatcgtaccgataggcctgcaaacgcaatgacgacgccagcggcaaaatgggcaattcctgcgccagaatactctgcgcttcgtcataggcttcaatacgcgccgccagctgctgcgaagagagcgccttacgcaatacgctgtcgaatttcggatcgcaccagtgggcgaggttggtctgcgaatgaattgccgcgcagctcagtaacggacggaagaaactgtccgggtcgttactgtccgtcgcccaaccggataacgtcagatcatggctcatatccatcaaccgcgcctcctgaaagcgaccttctaccggcacaatcaccacttttacgccaacctgcgccatatccgcctgaatcagttcggcagttttcagtggactggggttccacgcctgcgaacgtgtgggcacccacagtttcagcgttaaattttccagccccaacgacttcaactgttcgcgcgatttcgccggattgtattcagtaattttagcctcgttgtcataggcccacgaggcgcgcggtaaaatagaggccgccgtttcagccgtaccataatagatggattgcatcaggcgctggttattaatcgccagtgccagcgcatggcggacagcgggattatttagcggcggtttggcggtgttaaatgccagataggcgacgttcatcccaggacgcagcgttaaacgcaagcgcgggtcgtcacgcaaaatggatagctggctggcagcaggccaggccagaacgtcgcattccccggtcaggagtttcgacagacgtccggtgccgccggagcctaaatccaccactacctgcggcattaacggtttaccgcgccagaagtcatcatgacgttgtaggcgaataaattgcccggcgcggtattccgacaactgatacggaccggtgccgaccggttgacggtcgagttgctcctggcgatcttctttctctaacttccgggcatattctgccgacatgaccgaagcataatgggttgcgaggtgccacaaaaaagaagcatccggctgggcgagtcggaactcaacggtatgattatccagtttgcggacgcttttcacgttatcggcaaattgcaggctgtcgaagtaggggaagttgctgccgttgacgttatgccacgggttgttgcggtcaaaaattcgctggaaggtaaacaccacatcgtcggcattcattttacgagtgggagtaaaccagtcggttttttgaaacggaacatcgcgacgcaggtggaagcgataggtcgcgccgttgtcgagtacttcccagctttcggcaagttccggcatcaggcgataggtatagggatcgacatccagcagtcgatcataaaactgggcggcaagggtatcgacaattaacccactgctcgctttggatgggttaaaggtgttgacttgcccgctgacgcaatagacaaaaccgctgtcgcggatatcagcatgcgggggagattcaggcgcggcgattgcctgaccactcacaagtccagcaatcaccaaaagagacgataatacctggcgcataatattaagggattttatgtaaagaggctatcttactaatatttaatgacatttgccattaccgtttgtgttcaggggtcgtaatgagggccgtgtggttggtcgttgaacaggtgacgtcgccatctgttcaacattcgtacccgtgatttctctataactataactcacagaacaacttagcgaggagcagagcggtacgatcgtgagaaacccattaaagcacgctgcagtgcgtgtcattgttagccagatgcggcgtgaacgctttatccggacaacgatactgaccgatcgtctgcaattaaatcattactcattaccccattgattcaaaaactctgcgatctcatcaatgcgtacgggattaatccccgcttcagcagccatttcatgttgggcttcttcgctgatctcttcattgttcatcaaacgggtgagcagtaactggaagtagtgggccagcggtgtgcgttcagcctctgcgacaggctctgcgcattcggtcgcgtactcatcggcaatatcaaaatattttagcgggatatcgtggttcattatttgcccctggggttaatgcgctaagcataagggcggatgatagcactcgtgatccgggtcatacatctttttatagttaatggcgcggcgcgttaccctcaggcaggataatgcgccgcgcatccgactattacgtttcactcaccggcgttctgtcaccatcatacaacggcactttgcgatagcggcggatcagataccataaatatgcgccgcctaacgaagcccataccagaccgagtgtcagtgacgttgactcgaggttaacccacagcacacccaccgtcagcgcgccaaccagcggcatcagcaaatagtggaagtgatccttccagcttttattcattcctttacgccgccagaaatgattaaacaccgacagattcacgaaggtaaacgccaccagagcaccgaagttaattaacgctgtggcggtaactaaatcgaagaacagcgccgacaacgcgacaatcccgaccataatgacgttgagtgccggagtccgccattttgggtgcacatagccaaacacgcgctccggaaacacattgtcacgccccatcacatacagcagacgcgacacgctggcatgtgaagccaggccagaggctaacgtgttcacaaacgtggtgcagaggaaaatcgactggaagagcttgccgccgacgtacagcgcaatttcaggcagtgcggcatccggatctttaaagcggctgatatcgggaaagaacagctgcataaagaacgacgccgcgataaagataacgccaccgtagaccgccgtcaggaagatggctttcgggatcacgcgtgcggcgtccggcgtctcttccgaaagcgtggtcaccgcatcgaaaccgaggaaggagaaacagacaatcgtcgccccggtaataatcgggatcaggtgcgcgttctcgctgataaacggctgaagtgaccagacggtgccaacgccttctcctttatgcagtccctgaactaccaggaagataaacaccaccatgatggagatttgcaccagtacaaacagggtattgaagttagcgaccaggttgacgctcttcagattcgcggcggttaaaatggcgacgaaggttaccacccacacccacggcggcacttccgggaagagggcggagagatagattttcgccaacaagacgttaatcatcggcaaaaagagataatccagcagcgatgaccagccgaccataaatccgacgtgcgggttaatcgacttttgcgcgtaggtataggccgaaccggcctccggaaactggcgaaccagtttgccgtagctgatagcggtaaacagcacacccgccagcgccagcaaataggacgccggaacgtgaccgtcgctaatgccggagacaataccaaaagtatcaaatacggtcatcggcgtgagataggccagacccatcatcaccacctgccacaatttcagtgattttcgcagacgggttttgccgggttgcgcagcaatattcagtggtgaattaatagccataattgctgcctcccctgcgtaataaggtttgcggtcgtgtcgacctgaaatcaaacctgtttagcaagggaagcaaagggggcggagtccagtcagtagcaggaggggcgcatacgcagcctccctcgccatgcggggatttaatcatcggcatcatctcatttcctcgtcacagtcttaatcgttaacggaagcccgttgccgcccgcgctccataacgcgacatccgggaaatgtctggattaccagcaaatgtcaggcctggctccgctcaggccgatgaaacaaccccgcaaggggtattacgcgtttttcaacatccactcaatttctgtttctgtgatgaggcgctcaaactgcaacagctcatcatttttacaggcgtgatagacatggcagaagcgttcgcctaaatagcggcgcaggtgatcattctcgataaactcacccagggcatcgctctggcgaatcggaaagggtaagccttcctgttccagcccgttgccttcgacttcttcctgcaacggcagctcgttatcaaggccatgcaaaataccggcaaaaatcgctgccatcaccagatatgggttggcatcggcacccgccacgcgatattccacgcggtgattatgacggtcgccgcacggaatacgcagggcgacggtgcggttgttatggccccacgacgcctgcgtcggcacatacattcccggctggaagcggcgatacgagttcacgtttggtgccagcaacgccatcgacgacggcatcaggtcaatcatcccggcgagcatctttttcagcagcggcgaatcttcgccttccgcgtcagaaagcacgttctcgccacgattattttgcatactgatatggatatgcattccgctgcccgcgtgctcttcatacggcttcgccataaaagtggcgtgcatcttatgcttttctgccatcagacgcaccaggcgttttagtgccagcgcatcatcgcaggcttccagcacgttatcagtatggtaaaggttgatttcaaactgacccggcgaggcctcagcgaccgcgccatctgccggaatcagctgtaactgcgccagttcatcaatatcattgagcacgtcggcgaagtggttgaggttatcaacggagtaaacctggctttgtgtattgcggtcatcggtgccaggcgcgcagggcggttgcagatacccttcagcgtcgcgctggcgatccagtaaatagaactccagctctaccgctacgaccgggaacaatccgcgctggcgcagctgctgccacaggcggttaagaacgttccgcggctcaacgtcaaagggagcgccatcttcatcgaccatggtcaggagcatctgaccgataaactctggatcggcggcagaaggagttaaggaaccgagaacaggaacacaggtacgatccggctcgcccatttcctgacccagacctgcttcttctactacgttgcccagaatatccattgcaaataccgaggccgggaaataacaccctttctcgagcttcttcaggcttgaaacaggaatacgctttccacggaagcaaccatttaaatcggtaagtaaaacatcaacatattgcgtattcgggtagcgctccaggtagcgtttcacttcctgcgtaaaggcgctaccccgcctctcttctgactgctgaacaaagttctctacttcaacgatattggtttccatgattcttcgcctttggtttgttttccgctcgttatcaaagcgtaaaatataatgaccaccattcgaatctgtatgcaaactaaatgtttgtcaaatgttaaattgagtttgcaaaaatgaaaacccactgctagattgaaaaaatattgaacataaaggtcatttaaagcgcagtaatggcgataatttagtccactttgtgagattgagcatggaaaatataatgaacaatccggttatcggtgtcgtaatgtgcaggaacaggcttaagggtcatgcgacccagactctgcaagaaaagtacctgaatgccatcatccatgcaggcggcttgcctattgcgctaccacatgcgctggcggaaccgtcattacttgaacaacttttgccgaaactcgatggcatttatcttcctggtagtcccagcaatgtgcagccgcacctatatggtgaaaacggcgatgagcctgacgccgatcccgggcgtgatcttctgagcatggcgataattaatgccgcactcgaaaggcgcatccccattttcgccatctgccggggtttacaagaactggtggtggcaaccggtggttcgttgcatcgcaagctgtgcgaacagcctgaattgctggaacatcgggaagatcccgaactgccggtggaacagcaatatgcaccgtcgcatgaagttcaggttgaagaggggggattactgtctgcgttgttacctgaatgtagcaacttttgggtaaactctctacatggacaaggggcgaaggtcgttagcccacggttgcgtgttgaagctcgctcgccggatggcttagttgaggcggttagcgtcatcaatcatccttttgcgctgggcgtacagtggcacccggaatggaacagtagcgagtacgcgctttcgcgtatattgttcgagggctttatcaccgcttgtcagcaccatatcgctgaaaaacagcgactctgaccactacagtttaaggaaatgcaaatatgagtgatgagggactggcgccaggaaaacgcttgtcggaaatccgccagcagcaggggctttcacaacgtcgtgccgccgaactctccgggctgactcacagtgctatcagtacgatagaacaagataaagtcagccctgccatcagtacgctgcaaaagctgctgaaggtgtatggtctgtcactctcggaattcttttccgagccggaaaaacctgatgagccgcaggtcgtcattaatcaggacgacttaattgagatgggtagtcagggtgtgtcaatgaagctggttcataacggtaacccgaatcgcacgctggcgatgatctttgaaacgtaccagccgggcacaaccactggggaaagaattaagcatcagggtgaggaaataggcactgtactggaaggtgaaattgttctgacgattaatggtcaggattaccacctcgtcgcggggcaaagttatgccattaataccggcatcccgcacagtttcagtaatacgtcggcaggtatttgccgaattatcagcgcccatacgcccaccacgttttaatctttttgttctgtaagccgggtaagcgcaatgcgcccggcaatctatacacaaaatcattcaagttgcatcaaggcggcaagtgagcgaatcccgatgagcttactcaggtaagtgattcgggggagcgaacgcagccaaggcagaggcggcttgaaggatgaagtgtatataaagaatgtcgccagaaataaacgggcatacggcccggggatctctgcgccctgacgttcacaaactgcatatatctgatagacgtgaaacaggagtcataatgaattttcatcatctggcttactggcaggataaagcgttaagtctcgccattgaaaaccgcttatttattaacggtgaatatactgctgcggcggaaaatgaaacctttgaaaccgttgatccggtcacccaggcaccgctggcgaaaattgcccgcggcaagagcgtcgatatcgaccgtgcgatgagcgcagcacgcggcgtatttgaacgcggcgactggtcactctcttctccggctaaacgtaaagcggtactgaataaactcgccgatttaatggaagcccacgccgaagagctggcactgctggaaactctcgacaccggcaaaccgattcgtcacagtctgcgtgatgatattcccggcgcggcgcgcgccattcgctggtacgccgaagcgatcgacaaagtgtatggcgaagtggcgaccaccagtagccatgagctggcgatgatcgtgcgtgaaccggtcggcgtgattgccgccatcgtgccgtggaacttcccgctgttgctgacttgctggaaactcggcccggcgctggcggcgggaaacagcgtgattctaaaaccgtctgaaaaatcaccgctcagtgcgattcgtctcgcggggctggcgaaagaagcaggcttgccggatggtgtgttgaacgtggtgacgggttttggtcatgaagccgggcaggcgctgtcgcgtcataacgatatcgacgccattgcctttaccggttcaacccgtaccgggaaacagctgctgaaagatgcgggcgacagcaacatgaaacgcgtctggctggaagcgggcggcaaaagcgccaacatcgttttcgctgactgcccggatttgcaacaggcggcaagcgccaccgcagcaggcattttctacaaccagggacaggtgtgcatcgccggaacgcgcctgttgctggaagagagcatcgccgatgaattcttagccctgttaaaacagcaggcgcaaaactggcagccgggccatccacttgatcccgcaaccaccatgggcaccttaatcgactgcgcccacgccgactcggtccatagctttattcgggaaggcgaaagcaaagggcaactgttgttggatggccgtaacgccgggctggctgccgccatcggcccgaccatctttgtggatgtggacccgaatgcgtccttaagtcgcgaagagattttcggtccggtgctggtggtcacgcgtttcacatcagaagaacaggcgctacagcttgccaacgacagccagtacggccttggcgcggcggtatggacgcgcgacctctcccgcgcgcaccgcatgagccgacgcctgaaagccggttccgtcttcgtcaataactacaacgacggcgatatgaccgtgccgtttggcggctataagcagagcggcaacggtcgcgacaaatccctgcatgcccttgaaaaattcactgaactgaaaaccatctggataagcctggaggcctgaaatgaccgaacataccagcagttactacgccgccagtgcgaataaatatgcaccattcgacacgctgaatgagtcaatcacctgcgacgtttgcgtggttggcggcggctataccgggctctcctccgcgctgcatctggcggaagcgggctttgacgtagtggttctcgaagcctcacgcatcggctttggcgcaagcgggcgcaatggcggacagcttgtgaactcctacagccgcgacatcgacgtgatcgaaaaaagctacggcatggacaccgcccgtatgctcggcagcatgatgttcgaaggtggtgagatcatccgcgaacgtatcaaacgttatcagattgactgcgactaccgccccggcggcctgtttgtggcgatgaatgataaacagctcgccacacttgaagagcagaaagagaactgggaacgctacggcaataaacagctggaattgctggacgccaacgccattcgccgtgaagtagccagcgatcgctataccggtgcgctgctggatcacagcggtgggcatattcatccgctaaaccttgccattggcgaagcggacgccatccgcctcaacggcgggcgcgtgtatgaactttctgccgtgacgcagatccagcacaccacgccagccgttgtgcgaactgccaaaggtcaggtgacggcgaagtatgtgattgtcgccgggaatgcgtatctgggcgataaagtagagccggaactggcgaaacgcagcatgccgtgcggcacgcaggtgatcaccaccgaacggctgtcggaagatttagcccgttcgctgatcccgaaaaactactgtgtggaagactgtaactatctgcttgattactaccgtcttaccgccgacaaccgcctgctgtacggcggcggcgtggtctacggcgcgcgcgacccggatgacgttgagcgccttgtggtgccgaaactgctgaaaaccttcccgcagctgaagggcgtgaaaattgattaccgctggacgggcaacttcctgctgaccctgtcgcgtatgccgcagtttggtcgcctcgataccaacatctattacatgcagggctacagcggccacggcgtgacctgtactcatctagccggacgtttgattgccgaactgctgcgcggcgacgccgaacgtttcgatgccttcgccaatctgccgcattacccgttccccggcgggcgcacgctgcgtgtgccgtttaccgcgatgggcgcggcgtattacagcctgcgcgatcgtctgggcgtttaatttccgattaaccgtgaagagtcaaaaggtgtgaaacatgagcaacaatgaattccatcagcgtcgtctttctgccactccgcgcggggttggcgtgatgtgtaacttcttcgcccagtcggctgaaaacgccacgctgaaggatgttgagggcaacgagtacatcgatttcgccgcaggcattgcggtgctgaataccggacatcgccaccctgatctggtcgcggcggtggagcagcaactgcaacagtttacccacaccgcgtatcagattgtgccgtatgaaagctacgtcaccctggcggagaaaatcaacgcccttgccccggtgagcgggcaggccaaaaccgcgttcttcaccaccggtgcggaagcggtggaaaacgcggtgaaaattgctcgcgcccataccggacgccctggcgtgattgcgtttagcggcggctttcacggtcgtacgtatatgaccatggcgctgaccggaaaagttgcgccgtacaaaatcggcttcggcccgttccctggttcggtgtatcacgtaccttatccgtcagatttacacggcatttcaacacaggactccctcgacgccatcgaacgcttgtttaaatcagacatcgaagcgaagcaggtggcggcgattattttcgaaccggtgcagggcgagggcggtttcaacgttgcgccaaaagagctggttgccgctattcgccgcctgtgcgacgagcacggtattgtgatgattgctgatgaagtgcaaagcggctttgcgcgtaccggtaagctgtttgccatggatcattacgccgataagccggatttaatgacgatggcgaaaagcctcgcgggcgggatgccgctttcgggcgtggtcggtaacgcgaatattatggacgcacccgcgccgggcgggcttggcggcacctacgccggtaacccgctggcggtggctgccgcgcacgcggtgctcaacattatcgacaaagaatcactctgcgaacgcgcgaatcaactgggccagcgtctcaaaaacacgttgattgatgccaaagaaagcgttccggccattgctgcggtacgcggcctggggtcgatgattgcggtagagtttaacgatccgcaaacgggcgagccgtcagcggcgattgcacagaaaatccagcaacgcgcgctggcgcaggggctgctcctgctgacctgtggcgcatacggcaacgtgattcgcttcctgtatccgctgaccatcccggatgcgcaattcgatgcggcaatgaaaattttgcaggatgcgctgagcgattaatagcccaacgcaataatgtctgatgcgctgcgcttatcaggcctgcaaacgacgtattgattatgtatgccgaataaagcattcacgccgcatccggcaagttgtattgctcaacttcgctaaatctggtgctttttcaacaacgcgcggaactgatgataagttaaccccagtaattcagccgcgcgcttctggttatatttcccttgttgcaaactgagttgcagcaactctttttcctgctgcatctgaaactcacgtaaatccagcggcagtgttggaagcgaggtggtttctgaaacggcgatagcgtcttcaggcggacgccgtttaaagggatcaataatgatgtcatcaagcggataatcgctggtgccgtggcgatacactgaacgttccaccacgtttttcaattcacgaatatttcccggccaacgataattcagcaatgtttctctggcgcgctccgtaaaccccgggaacagaggcagcttgatttcccgacacatctggatggcaaagtattctgccatcaacattatgtcgctttcgcgctcgcgcagtggtggcagttgtacaacatcaaaagccagtcggtcgagcaggtcagcgcgaaaagtgccttcattgaccatcgccgggagatcggcattcgtcgcgcataccaaccgcacattcacctgcaatggttggctgccgccaacgcgctccagttcaccgtactcaatcacgcgcaataatttctcctgcaccatcatcggtgccgtagcgagttcatcaagaaatagcgtaccgccgtcggcacgttcaaatctccctggatgacgtttttgcgcaccggtaaacgcccccgcttcgtgaccaaacagttcggaatccagcagattttcatttaacgccgcgcagttaagggaaataaacggcccttgccaacgggaggagagataatgcaggcggctggcaatcagctctttaccggtgccgcgttcgccgatgatgagcaccggtttgtccagcggtgcgagatgcgaaacctgttccagcacttcgagaaagctgttcgcctcaccaagtaaattatctttgtattctgccatgatgaaattcgccacttgttagtgtaattcgctaactcatcctggcatgttgctgttgattcttcaatcagatctttataaatcaaaaagataaaaaattggcacgcaaattgtattaacagttcagcaggacaatcctgaacgcagaaatcaagaggacaacattatgggtattttttctcgctttgccgacatcgtgaatgccaacatcaacgctctgttagagaaagcggaagatccacagaaactggttcgtctgatgatccaggagatggaagatacactggttgaagtacgttctacttcggcgcgcgcgttggcagaaaagaaacagctgactcgccgtattgaacaagcgtcggcgcgtgaggttgaatggcaggaaaaagccgaactggcgctgctgaaagagagagaggatctggcacgtgcagcgttaattgaaaaacagaaactgaccgatctgattaagtccctggaacatgaagtgacgctggtggacgatacgctggcacgcatgaagaaagagattggcgagctggaaaacaaattgagcgaaacacgcgctcgccagcaggcattgatgttacgtcatcaggcggcaaactcgtcgcgcgatgtgcgtcgtcagctggacagtggcaaactggatgaagcaatggctcgtttcgaatctttcgaacgtcgtattgaccagatggaagcggaagcagaaagccacagcttcggtaaacaaaaatcgctggacgatcagtttgccgaactgaaagccgatgatgcaatcagcgaacaactggcacaattaaaagccaaaatgaagcaagacaatcaataataacatccaggcggcgtccgaacgcgccgccgctcatcgtctaaggagtacttatgagcgcgctatttctggctattccgttaaccatttttgtgctgtttgttttaccgatctggttatggctgcattacagcaatcgttctggtcgcagtgaattgtcgcaaagtgagcagcagcgattagcgcaactggctgatgaagcaaaacggatgcgcgaacgtattcaggcgctggaatctattcttgatgcagaacatccgaactggagggatcgctaatggcgggcattaatctcaataaaaaattatggcgtattccacagcagggcatggtccgcggcgtctgcgccgggattgccaactattttgatgtaccggtaaaactggtgcgtatcctggtggtgctgtcgattttcttcggtctggcgctgtttaccctggttgcttacatcattttgtcatttgcgcttgatccaatgccggacaacatggcctttggtgagcagctaccttccagcagcgaattgctggatgaagtcgaccgtgaactggcggcaagtgaaacgcgtttacgcgagatggaacgttatgtcacttccgatactttcacgttacgtagccgtttccgtcaactgtgaggaaagttatgaatactcgctggcaacaggccgggcaaaaggtaaagcctggtttcaaattagcaggcaagctggtacttcttaccgcactgcgctatggcccggcgggtgtggcgggctgggcgataaaatcagttgctcgccgaccgctgaaaatgttgctggctgtggcgctggaaccgctgttaagtcgggctgctaataaactggcacagcgttataaaaggtgaggggagtttcgcaaaaattgttaaatctcaggcgtataatggatggcaattttcatccatagaaggacgcttacatgtttaaaaaaggcttacttgctctggcactggtgttttcactgcccgttttcgccgctgaacactggatcgatgttcgtgttccagagcagtatcagcaagagcacgttcagggggccatcaatattcccctgaaggaagtgaaagagcgcattgccaccgccgttccggataaaaacgacaccgtgaaagtgtattgcaatgccggacgccagtcagggcaagcaaaagagatccttagcgagatgggatatacccacgttgagaacgccggtggcctgaaagacatcgcaatgccgaaggtcaaaggttaaaagaattcaccatgagcggcgcttatgcgccgtttttttttctgtcacaccttatttacatccccatagattatttgcgtcagctcacaaatacgctttttccctggtaaaaaatgatttcctgcgtgactaaaacccttgtgctcaattgacagtttattttctgcggagtagtctctcgtttcatgggaccgctaccacggaaaggcaacatgaaacagaaaattacggattacctggacgaaatctacggtggaacatttaccgcaactcatttacagaaacttgtaacgcgtcttgagagtgcgaaacgattaattacacagcgacgtaaaaaacactgggatgaaagtgatgtcgtgttaattacctatgccgatcaatttcacagcaatgatttaaaaccattacccacatttaatcagttttaccatcaatggctgcaaagcattttttcacatgttcatttgttgccgttttatccatggtcatctgatgatggcttttcggtaattgattatcatcaggtcgccagtgaagcgggggagtggcaggatattcagcaactcggtgaatgcagtcatttaatgtttgattttgtctgcaaccatatgtcggcaaaaagtgaatggtttaaaaactatttacaacagcatccaggttttgaagatttttttattgccgttgacccgcaaaccgatctcagcgccgtcactcgcccgcgtgcgttaccgttattaacgccattccagatgcgcgatcattcaacgcgccatttatggaccacctttagtgacgatcaaattgacctgaattaccgtagccctgaagtgttgctggcgatggtggatgttttactctgttaccttgcgaaaggtgctgagtatgtccgcctggatgccgttggctttatgtggaaagagccgggaacaagctgcatccatctggaaaaaacacatctgattatcaaactgttacggtcgattattgataacgttgcgccaggtacagtgatcattaccgagaccaatgttccgcataaagacaacattgcttactttggcgcaggcgatgacgaagcacatatggtgtaccagttctcgctgccgccactggtgctgcatgcggtgcaaaaacagaacgttgaggcgctttgtgcgtgggcgcaaaacctgacactaccttccagcaacaccacctggtttaacttcctcgcctctcacgatggcatcgggctaaacccgctacggggcttgttgcctgaaagcgaaatattagagctggtcgaggcgttacagcaggaaggtgcattagtaaactggaaaaataatcccgacggtacacgcagtccgtatgaaataaatgtgacctatatggatgcgttaagccgccgtgagagtagcgatgaagaacgttgcgccaggtttatccttgcccatgcgattttgttaagtttccccggtgtgccagcgatatatattcaaagtattcttggctcgcgtaatgattacgcaggtgtcgaaaaactcggatataaccgtgcgattaaccgtaaaaaatatcacagtaaagagataacccgagaactgaacgatgaagctacattaaggcatgcggtatatcatgagttgtcgcgtttaattacacttcgtcgcagccataacgagtttcatccggataataattttaccattgatacgattaattcatccgtaatgcgtattccaagaagtaacgctgatggtaattgtctgactggattgtttaatgtcagtaaaaatattcagcatgtaaatattactaatctgcatggtcgggatctgattagtgaagttgatatattgggtaatgaaataacgctgcgcccctggcaggttatgtggattaaataaaaaggaacatctcatgattaaatcaaaaatcgtgctgttatcagcactggtttcatgcgccctgatttcaggctgtaaagaagaaaataaaacgaatgtatccatcgaatttatgcattcttcggtggagcaggagcgccaggccgttatcagtaaattgattgcccgttttgaaaaagaaaaccctggcatcaccgttaagcaagtgcccgtggaagaagatgcctataacactaaagtcattactctttcacgtagcggttcgctgccggaagtgatcgaaaccagccatgactacgccaaagtgatggacaaagagcagcttatcgatcgcaaagcggttgccacagtcatcagcaacgttggtgaaggcgcgttttacgatggcgtactgcgtattgtgcgtaccgaagatggtagcgcatggaccggtgttcctgtcagcgcctggattggcggtatctggtatcgcaaagatgtgctggcaaaagcggggcttgaggagccgaaaaactggcaacagctgctggacgttgcacagaaactgaatgacccggcgaataaaaaatacggcattgcgctgcctacagcagaaagcgtgttgacggaacaatccttctcccagtttgcgttatccaaccaggctaacgtctttaacgccgaaggcaaaatcacccttgatacaccagagatgatgcaggcactgacctattaccgcgaccttactgccaacactatgccgggttctaacgacatcatggaagtgaaagacgcctttatgaacggcaccgcgccgatggcgatttactccacctatatccttccggctgtgattaaagaaggcgacccgaaaaacgtcggtttcgtggtgccaaccgagaaaaactctgcggtctacggcatgttgacctcgctgaccattaccgccgggcaaaagaccgaagagacggaagcagcagaaaaatttgtcacctttatggagcaggcagacaacattgccgactgggtgatgatgtcgccaggtgctgcgctgccggtgaataaagcggtggtgactaccgccacctggaaagacaacgacgttattaaggcgctgggtgaactaccgaatcagctaatcggtgaactgccaaatattcaggtttttggcgcagtaggggataaaaactttacccgcatgggtgatgtgacgggttctggcgtggtgagttcaatggtgcataacgtcaccgtgggtaaagccgatctctctactacgctgcaagcgagccagaaaaaactggatgaactgatcgaacagcactaaacccaggacaggaatccgcaatgaacaggcttttttcaggtcgttccgatatgccctttgcgctgctgcttctcgcgcccagcttattactgctgggcggtctggtggcgtggccgatggtgtcgaatatcgaaatcagttttttacgtctgccgctcaatcccaacatcgagtcaacgtttgttggggtgagcaactatgtgcgtatcctctccgatcccggcttctggcattcgctgtggatgacggtctggtataccgcgctggtggtggcgggcagcaccgtgctcgggctggcggtggcgatgtttttcaaccgcgagttccgcctgcgcaaaaccgcgcgttcgctggtgatcctctcctacgtaacgccgtccatttcgctggtgttcgcctggaaatacatgttcaacaacggctacggcattgttaactacctcggcgtcgatcttctgcatctctatgagcaggcaccgctgtggttcgataatccgggcagtagctttgtgctggtggtgctgttcgccatctggcgctacttcccgtatgcctttatctcgtttctggcgattttgcagaccatcgacaaatcgctgtacgaagcggcagagatggatggcgctaatgcctggcaacggtttcgtatcgtcacgctgcccgcaattatgccggtcctggcgacggtggtgacactgcgcaccatctggatgttctacatgttcgcggatgtttatttgctgacgaccaaggtcgatattctcggtgtatatctctacaaaaccgcctttgcctttaatgatttaggaaaagcggcggcgatctcggtggtgctcttcatcattattttcgctgtcattctgctgaccaggaaacgggtgaacctcaatggcaacaaataaacgcacactcagtcgcatcggtttttactgcgggctggcgctgtttctcatcatcacgctgtttccattttttgtgatgctgatgacctcgttcaagggcgcgaaagaggcgatctcactgcatcctacgctgctgccgcagcagtggacgctggagcattacgtcgacatttttaacccgatgattttcccgtttgtcgactacttccgtaacagtctggtggtgtctgtggtttcatccgtggtggcggtattcctcggcattcttggggcttacgcgctttcccgcctgcgctttaaaggtcggatgaccatcaacgccagcttttacacggtgtatatgttctctggcattttgctggtggtgccgcttttcaaaatcatcaccgcgcttggcatttacgacactgagatggcgctgatcatcaccatggtgacgcaaactctgcccaccgccgtgtttatgctgaaaagctacttcgacaccatccccgatgagatcgaagaagcggcgatgatggatggcctcaaccgtctgcaaattatcttccgcatcaccgtgccgttggcgatgtccgggctgatatccgtgttcgtctactgctttatggtggcgtggaacgactatctgtttgcgtcgattttcctctccagcgccagcaatttcaccttaccggtgggcctgaacgcgctgttcagtacgccagattacatctggggacggatgatggcggcctcactggtgaccgcattgccggtggtgattatgtatgcgctttcggaacgttttattaagagtggtttgaccgccggtggcgtgaagggctaaagcggccagtttctttacaaggagttttaaatgaaaaagttagtagccacagcaccgcgtgttgctgcgctggttgagtatgaagatcgggcgattttagctaatgaagtgaagatccgcgtgcgtttcggcgcaccgaaacacggaacggaagtggtcgacttccgcgccgccagcccgtttattgatgaagactttaacggcgaatggcagatgttcactccgcgtccggcagatgcgccgcgcggcattgagtttggcaaattccagcttggcaacatggtggttggcgacattatcgagtgcggcagcgacgttaccgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtgcgcgtaggggattttgtggtggtggtagggcttggcgcaatcggtcaaattgccatccaactggctaaacgcgctggcgcttctgtggtgattggcgtcgatcctatcgcccatcgctgtgatattgcccgtcgccacggcgcggatttctgccttaaccccatcggcactgatgtaggtaaagagatcaaaacgctgaccggcaagcagggtgccgatgtgattatcgaaaccagcggctacgccgacgcgctgcaatcggcgctccgcggtctggcttatggcggcaccatctcctatgtcgcgtttgccaagccgtttgccgaaggttttaacctcggacgcgaagcgcatttcaataacgccaaaattgtcttctctcgcgcgtgcagcgaaccgaacccggattatccgcgctggagccgcaagcgtattgaagaaacctgttgggaactgctgatgaacggttatctcaattgcgaagatttaatcgacccggtggtgacctttgccaatagcccggaaagctatatgcagtatgtcgaccagcatccggaacagagcatcaaaatgggcgttacgttttaattcaaaggaatgaaaaaaatgaaaatcggcacacagaatcaggcgttctttccggaaaacattctggagaaatttcgttatatcaaagagatgggcttcgatggttttgagattgacggcaaactgctggttaacaacatcgaagaagtcaaagcggcgatcaaagaaaccggtttaccggtgaccaccgcctgcggtggctatgacggatggattggcgactttatcgaagagcgtcgtcttaatggcttaaagcagatcgagcgcattctcgaagcgctggcagaagtgggcggtaaaggcatcgtcgttccggctgcgtggggcatgtttaccttccgcttaccgccgatgacctcgccgcgtagcctggacggcgaccgcaaaatggtgagtgattccctgcgcgtactggaacaggtcgccgcgcgtaccggaaccgtggtgtatctcgaaccgttaaaccgctatcaggatcatatgatcaacaccctcgccgatgcccgccgttacatcgtcgaaaacgatcttaaacatgtacagattatcggcgatttctatcacatgaatatcgaagaagataacctggcgcaggcgctgcatgacaaccgcgacctgctcggtcatgtgcatattgcggataaccatcgctaccagccgggcagcggcaccctggatttccacgcgctgtttgaacagctgcgcgcggataactatcagggctatgtagtgtacgaagggcgtatccgggcggaagatcctgcccaggcgtaccgtgattcgttggcctggttgcgtacctgctaagaggtctttgtgaaaagtgcaatgacaagctctccgctgcgggtcgcgataataggcgcaggccaggtggcggataaggttcatgcttcgtactactgcacccgcaacgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcactggaagcgggctgccatgtgatgtgcgaaaaaccgcccgccatgacgccagaacaggcgcgggaaatgtgcgataccgcgcgcaaactgggcaaggtgctggcctacgactttcaccatcgttttgcgctcgatacgcaacagctgcgtgaacaggtgaccaacggcgttttgggagagatttacgttaccaccgcccgcgccctgcgtcgctgcggcgttcccggctggggtgtctttaccaataaagaactgcagggtggtggcccgctgatcgacatcggcattcatatgctggatgctgcgatgtatgtgctgggctttccggcggtgaaaagcgtgaatgcgcatagctttcaaaagatcggcacgcaaaagagctgtggtcaatttggtgagtgggatccggcaacttacagcgtcgaagattcgctgtttggcaccattgaatttcataacggcggcattctgtggctggaaacgtcatttgcactcaacatccgcgaacagtcgattatgaacgtcagcttttgtggtgataaagctggtgcgacgctgtttccagcacatatctacaccgataacaacggtgaattaatgacgctgatgcaacgggaaatagcagacgacaaccgccatttgcgcagcatggaagcctttatcaatcacgtacagggcaagcccgtgatgatagccgacgccgagcaggggtacatcatccagcaactggtggcggcgttgtatcaatccgcagaaacagggacgcgtgtggaattatgaccaggccagtaacgttatcagaaccccatttcagccagcataccctgaacaagtatgcatcgctgatggcgcaggggaacggctatcttgggcttcgcgccagccatgaagaagattacacgcgccagacgcgagggatgtatctggcggggctgtatcatcgggcgggaaaaggtgaaatcaacgaactggtgaacctgcctgatgtcgtggggatggagattgccataaatggtgaggttttctcgttatcccacgaagcctggcagcgtgagcttgactttgccagtggcgaattacgccgcaatgttgtctggcgtaccagcaacggctcaggttacaccatcgccagccgtcgctttgtttcggcagaccaactgccgctcattgcgctggaaatcactattacgccactggacgccgacgcgtcagtgctgatttcaacaggcattgacgccacgcaaaccaatcacggtcgccaacatctcgacgaaacccaggtgcgggtgtttggtcagcatctgatgcaggggagctacaccacccaggatggacgcagtgatgtggccatcagctgttgctgtaaggtgagcggtgatgtgcagcaatgctataccgccaaagagcgccgtttactgcaacataccagtgcgcagcttcatgcaggcgagacaatgacgttgcaaaaactggtgtggatcgactggcgggatgacaggcaagctgctttagacgagtggggcagcgcgtcgcttcgccagcttgaaatgtgcgcgcagcagagttacgaccaacttcttgcagcatcaacagaaaactggcgtcaatggtggcagaaacgtcgtatcacggtaaatggcggcgaagcgcacgatcagcaagcgttagattatgcgctttatcatctgcgcatcatgacgcctgcccacgacgagcgcagcagcattgcggcaaaaggcttaaccggcgaaggctacaaaggccacgttttctgggatacagaagtatttttgttaccgtttcatctgtttagcgatccgacggttgcccgaagtttactgcgttatcgctggcacaacttgccaggcgcgcaggagaaagcgcgacgcaacggctggcagggcgcgctatttccgtgggaaagcgcgcgcagcggcgaagaagagacgccggaatttgccgccattaacattcgcaccgggctgcggcaaaaagtggcctcggcgcaggcggaacatcatctggtggccgatatcgcctgggcggttattcaatactggcagaccacgggggatgaaagtttcattgcgcatgaaggcatggcgctacttctggagacggcaaagttctggattagccgcgcggtgagagttaacgatcgtctggaaattcatgatgttattgggccagacgaatataccgaacatgtcaataataatgcatacaccagctatatggcccgctacaacgttcaacaggcgctgaatattgcccgccagttcggctgtagcgacgatgcgtttatccatcgcgccgaaatgttcctcaaagagctatggatgccagaaattcagcccgacggcgttttgccgcaggatgattcgtttatggctaagccggcgattaatctggcgaaatacaaagcggcggcggggaagcaaaccatactgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgctgacccaaagttatcagttctggcgcgaggggactgaaatcgatcttggtgctgatccgcatagttgtgatgatggtatccatgctgccgcaactggcgctatctggctgggggcgattcagggttttgccggggtgagcgtgcgtgacggtgaattgcatctcaatccggcgttacctgagcagtggcaacagttgtctttccctctgttctggcagggctgcgaattacaggtcactcttgacgcgcagcgtattgcgattcgaacttctgcgcccgtttcactgcgtttgaacggtcagcttataaccgtggctgaagaatctgttttctgtttgggtgattttattttgcccttcaatgggaccgctaccaaacatcaggaggatgaatgaaactgcaaggggtaattttcgatctggatggtgtaatcaccgataccgcgcatctgcatttccaggcgtggcagcagattgccgctgaaattggcatcagcattgatgcgcagtttaacgaatccctaaaagggatcagccgcgatgagtctctgcggcgcattctgcaacacgggggcaaagagggcgactttaactcgcaggagagggcgcaactggcgtatcgcaaaaatctgctctatgtccactcactacgcgagttgacggtcaacgctgttctacccggcattcgctctttgctggcagatctccgtgcacagcagatctcggttgggctggcttctgtctccctgaatgcgccgacgattttagcggcgctggagctgcgcgagtttttcaccttctgcgcggatgcttcccaacttaaaaactcgaaaccggacccggaaatctttctcgccgcctgtgcagggctgggcgtgccgccgcaggcatgtatcggcattgaagatgcgcaggcgggcattgacgccattaacgccagcggtatgcgctcggtggggatcggcgcgggcttaaccggggcgcaattactgttgccttcaacggaatcactcacctggccgcggttatcggccttctggcaaaacgtatagcaaaggaatcaacatggctcagctttcgttacaacatattcaaaaaatctacgataaccaggtgcatgtggtgaaggacttcaacctggaaattgccgataaagagttcatcgtgtttgtcggcccgtcgggctgcggtaagtcgaccaccctgcgcatgattgccgggcttgaggagatcagcggcggcgatctgttgatcgacggcaaacgaatgaatgacgttccagccaaagcacgcaatatagcgatggtgttccagaactacgcgttgtatccgcatatgacggtttacgacaacatggcgtttggtctgaagatgcaaaaaatcgccaaagaggtgattgatgagcgggtgaactgggcggcgcaaattctcggcctgcgtgagtacctgaaacgtaagccgggggcgctttccggcgggcaacgtcagcgagtggcgcttgggcgggcgattgtacgcgaagcgggcgtgtttttaatggatgaaccgctctctaaccttgatgccaagctgcgcgtgcaaatgcgcgcagagatcagcaagctgcatcagaaactgaacaccaccatgatctacgtgacccacgatcagaccgaagcgatgaccatggcgacgcggattgtgattatgaaagacgggattgttcagcaagtaggtgcgccgaaaaccgtttataaccaacccgcgaatatgtttgtttccggatttattggatcaccagcgatgaattttattcgcggcacgatcgatggcgataaattcgttacggaaacgcttaaattaaccattcccgaagagaaattagcggttctgaaaacacaggaaagtttgcataagcccatcgtgatgggaatacgaccggaagatattcatccggacgcgcaagaggaaaataacatttccgccaaaattagcgtggcagaattaaccggtgcggaatttatgctctacaccacggttgggggcacgagttagtggtccgtgctggtgcgttaaatgattatcatgcaggagaaaatatcactattcattttgatatgacgaaatgtcatttctttgatgcagaaacggaaatagcaattcgctaaatacagggggaaggcattcccccaggataatacaaggaacaataatgaaaaagttattaccctgtaccgcactggtgatgtgtgcgggaatggcctgcgcacaggccgaggaaaggaacgactggcactttaatatcggcgcgatgtacgaaatagaaaacgtcgagggttatggcgaagatatggatgggctggcggagccttcagtctattttaatgccgccaacgggccgtggagaattgctctggcctattatcaggaagggccggtagattatagcgcgggtaaacgtggaacgtggtttgatcgcccggagctggaggtgcattatcagttcctcgaaaacgatgatttcagtttcggcctgaccggcggtttccgtaattatggttatcactacgttgatgaaccgggtaaagacacggcgaatatgcagcgctggaaaatcgcgccagactgggatgtgaaactgactgacgatttacgtttcaacggttggttgtcgatgtataaatttgccaacgatctgaacactaccggttacgctgatacccgtgtcgaaacggaaacaggtctgcaatataccttcaacgaaacggttgccttgcgagtgaactattatctcgagcgcggcttcaatatggacgacagccgcaataacggtgagttttccacgcaagaaattcgcgcctatttgccgctgacgctcggcaaccactcggtgacgccgtatacgcgcattgggctggatcgctggagtaactgggactggcaggatgatattgaacgtgaaggccatgattttaaccgtgtaggtttattttacggttatgatttccagaacggactttccgtttcgctggaatacgcgtttgagtggcaggatcacgacgaaggcgacagtgataaattccattatgcaggtgtcggcgtaaattactcgttctgataatgggctaaattgccggatgcggcgcgagtactttatccgatctataaatgtaggccggataagatgcgctagcatcgcatctggcattcaggcaaggtagctggtatttatttcagcgtcatatgcgtggcaacggtaatattctgtggtgacggttttccagaaattaagcggaataataactcgcagctttgttgacctaactcctgcgtcggaacatcgatgccgcccggtgcaggcgttaaaataaatgacagcgtttcattgctataacccaccaccgctaactgctgcggaatagcaatatttttctctgctgccgcacgataaatgctcattaatttcaggctgtcagtggcaaacaccgcctcaggcaacggtgactggcttaataattgccgtgctgcttttaatgcagtttcatgggtataaccgccatcaacaatccattcatcacgcactgcaatattatgcgcagccaggctctgcttataaccattaacgcgatcaaccgaaacatggacatcaagcggagcatgcaggcaggcaatattttgatgcccactttcaattaatgcatcggtcaacgcaatgctgtcgccaaaattatcggtatcgacagaataaacatgggcatattgaccttcaactttgccaatcaccaccaccggaatatcatatttatcgagttgggcaaaaaatgactcatccgctggcgaactgagcataataatgcctttaatcattttctgcttaattttgctttcgcatttttgcagatcttctgccggattgtgcgacgtttgtaatatcacgtcgaaaccttcttcttcagctttggcggtgatggcatgcaaaacttcagagaaaaacggattacccgccgtagttttggtcgaacgggtagaaatcaccataatggcatcaaaacccgaagaggtcagcgcgcgggccagcttgtttggctgatactgtaattcttcaatggcccgtaacactttttcgcgcgcttccggggagatattagtttgcttattcagcacgcgtgatacggtggattttgatacgcctgcaaccctggcaatatcataaatagtaggggacataggtcaggaactccgtccgaacgtgaatgctgcacatcttatggagttcgccggtcgatgacaacacgggcagttgataatcaatggcctggcccccacattcatatccttacgaatgattttttttctggtcttcagagcagcacaggacagcaatgaagcgacttaaaaatgaactcaatgcgctggtgaatcggggtgtcgacagacatctgcgcctcgctgtaaccggacttagccgcagcggcaaaacagcgtttatcaccgcgatggttaatcagttgcttaatattcacgccggagcacgtttgccgctgttaagtgcggtgcgtgaagagcgcctgctgggcgtgaaacgcattccccagcgtgactttggcattccgcgcttcacctatgacgaagggctggcgcagttatatggcgatccacccgcctggccaacgccaacgcgcggcgtcagtgaaatccgcctggcgctacgttttaaatcgaatgattcgctgctacgccactttaaggatacctccacgctgtatctggaaattgtggattatcccggcgaatggttgctcgacctgccgatgctggcgcaggactatttaagctggtcgcgccagatgacgggcttactcaatggtcagcgcggagaatggtcggcgaaatggcgaatgatgagcgaagggctggacccgctagcgcctgccgacgaaaaccggctggcggacattgccgccgcgtggaccgattatctccaccactgtaaagagcaggggctgcactttattcagcctgggcgctttgtcttgccgggagatatggcaggtgcgcccgcgctgcaattcttcccgtggccggatgtcgatacctggggcgagtccaaactggcgcaggccgataagcataccaatgccggaatgctgcgcgagcgctttaattattactgcgagaaggtggtgaaggggttctataagaatcattttctgcgctttgaccgccagattgtgctggtggattgcctgcaacctctcaacagtgggccacaggcatttaatgatatgcgtctggcactgacgcagctgatgcaaagttttcactacgggcagcgtaccctgttccggcgtttgttttcgccggttatcgataagctattgtttgctgccactaaagcggaccatgtgaccatcgatcagcacgctaatatggtttcattactgcaacaactgattcaggatgcctggcaaaatgcggcgttcgaagggatcagcatggactgcctggggctggcgtcagttcaggcgaccaccagcggcattattgatgttaacggtgagaaaatcccggcgctgcgtggtaatcgacttagcgatggcgcaccgctcactgtttatcctggcgaagttcccgcacgtttgcctggtcaggcgttctgggataagcaaggcttccagtttgaggcatttcgtccgcaggtgatggatgtcgacaaaccactaccgcatattcgtcttgatgctgcgctggaatttttaataggagataaattgcgatgaccgaaccgttaaaaccacgtattgatttcgacggtcctctggaggtcgatcagaatcctaaattcagggcgcagcagacctttgacgaaaatcaggcgcaaaattttgccccggccacgctcgacgaagcgcaggaagaagaggggcaagtcgaagcggtaatggacgcagcgttacgtccgaaacgcagcctgtggcgcaaaatggtgatgggagggctggctctgtttggcgcaagcgttgtcgggcagggtgtacagtggacaatgaatgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgtgatttattgcatagccacggcacgggcaaaggccgcgcattttgcgaaaaactggcgcagcaggcgggtattgatcagtcgcatccggcgctgcaacgctggtatgcctcaatccatgaaacgcaaaacgaccgtgaagtggtcagcctgtatgcgcatttggtccagccagttttagatgcccaggcgcggcgcgaaatcagccgttcggcggcggaatcaacgttgatgattgcggtcagcccgctggcgttggtcgatatggcgtttatcgcctggcgcaatctgcgtttaattaatcgcatcgccacgctgtatggcattgaactggggtattacagccgtttgcgtctgtttaagctggtattgctgaatatcgcttttgccggagccagcgaactggtgcgcgaagtggggatggactggatgtcgcaagatctcgctgctcgtttgtctacccgcgcagctcaggggattggtgcaggacttctgacggcacgactcgggattaaagctatggagctttgccgcccgctgccgtggattgacgatgacaaacctcgcctcggggatttccgtcgtcagcttatcggtcaggtgaaagaaacgctgcaaaaaggcaaaacgcccagcgaaaaataatgcaatatcgggtgctgaccggatatctttacgccgaagtgcccgtttttccgtctttgtgtcaatgattgttgacagaaaccttcctgctatccaaatagtgtcatatcatcatattaattgttcttttttcaggtgaaggttcccatgcgtctggaagtcttttgtgaagaccgactcggtctgacccgcgaattactcgatctactcgtgctaagaggcattgatttacgcggtattgagattgatcccattgggcgaatctacctcaattttgctgaactggagtttgagagtttcagcagtctgatggccgaaatacgccgtattgcgggtgttaccgatgtgcgtactgtcccgtggatgccttccgaacgtgagcatctggcgttgagcgcgttactggaggcgttgcctgaacctgtgctctctgtcgatatgaaaagcaaagtggatatggcgaacccggcgagctgtcagctttttgggcaaaaattggatcgcctgcgcaaccataccgccgcacaattgattaacggctttaattttttacgttggctggaaagcgaaccgcaagattcgcataacgagcatgtcgttattaatgggcagaatttcctgatggagattacgcctgtttatcttcaggatgaaaatgatcaacacgtcctgaccggtgcggtggtgatgttgcgatcaacgattcgtatgggccgccagttgcaaaatgtcgccgcccaggacgtcagcgccttcagtcaaattgtcgccgtcagcccgaaaatgaagcatgttgtcgaacaggcgcagaaactggcgatgctaagcgcgccgctgctgattacgggtgacacaggtacaggtaaagatctctttgcctacgcctgccatcaggcaagccccagagcgggcaaaccttacctggcgctgaactgtgcgtctataccggaagatgcggtcgagagtgaactgtttggtcatgctccggaagggaagaaaggattctttgagcaggcgaacggtggttcggtgctgttggatgaaataggggaaatgtcaccacggatgcaggcgaaattactgcgtttccttaatgatggcactttccgtcgggttggcgaagaccatgaggtgcatgtcgatgtgcgggtgatttgcgctacgcagaagaatctggtcgaactggtgcaaaaaggcatgttccgtgaagatctctattatcgtctgaacgtgttgacgctcaatctgccgccgctacgtgactgtccgcaggacatcatgccgttaactgagctgttcgtcgcccgctttgccgacgagcagggcgtgccgcgtccgaaactggccgctgacctgaatactgtacttacgcgttatgcgtggccgggaaatgtgcggcagttaaagaacgctatctatcgcgcactgacacaactggacggttatgagctgcgtccacaggatattttgttgccggattatgacgccgcaacggtagccgtgggcgaagatgcgatggaaggttcgctggacgaaatcaccagccgttttgaacgctcggtattaacccagctttatcgcaattatcccagcacgcgcaaactggcaaaacgtctcggcgtttcacataccgcgattgccaataagttgcgggaatatggtctgagtcagaagaagaacgaagagtaagcgcgaatatgcctgatggtgcaacaccatcaggcatattaaattatgctttcagtacagccagagctgcttcgtaatccggctcggtggtgatttcatccaccagctggctgaaaatcacattgtcattttcgtcaataaccacaacggcacgcgctgccagacctttcagtgggccatcagcaattgccacaccgtaagcttgcagaaattcagcgttacggaaagtggagagggtgataacgttgttcagaccttctgcgccgcagaaacgagactgggcgaacggcagatcggcagagatacacagcacaacggtgttgtcgatctcagttgccagttggttaaacttacgtactgatgcggcgcaaacaccggtatcaatactcgggaaaatgttcagcactttgcgtttacccgcaaactgaccgagggtgacgtcagacagatcttttgccacgagagtaaaagtctgcgctttgctacccgcctgcgggatggaattggcgactgtaaccgggttgccctggaaatgaacggtttgtgacatgattatctttcctgtttacatatagttaacgtcacacctagtttatgctaactgtcaataacacagcaaacgctatttgcgcttaatccgcagaccaccgcgacaacaaggagtaaagatgagaaccgttaaggtattcgaggaagcctggcccttacataccccgtttgtgattgcccggggaagtcgcagtgaagcgcgcgtggtggtggttgaactggaagaagagggtattaaaggcaccggcgaatgcacgccgtatccgcgttatggggaaagtgatgcctcggtaatggcgcaaattatgagcgtcgtgccgcaactagagaaagggctgacacgggaggagttgcaaaaaattctccctgccggcgcagcacgtaatgcgctggattgtgcattgtgggatctggccgcgcgaagacagcagcaatcgctggctgatttgatcggcataacgcttcccgagacagttatcactgcacagacggttgtcatcggtacgcctgatcagatggccaatagtgcatcaacactctggcaggcaggcgcgaaattactgaaagtgaagctggataaccatcttatcagtgagcggatggtggcaattcgcacagctgtgcccgatgcgacgctgatcgttgatgcaaatgaatcctggcgtgcagaagggttggcggcgcgttgccagctattggcggatttaggcgttgcgatgcttgaacaaccgcttcctgcgcaggacgatgcggcgctggagaattttattcatccgttgccgatttgtgctgatgaaagttgtcatactcgtagcaatttgaaggcgctgaaagggcgctatgagatggttaatattaagctcgataaaaccgggggtctgacggaagcgctggcgctggcgactgaagcgcgtgcacaaggtttcagtctgatgctgggctgcatgttgtgtacctctcgtgccattagcgccgctttaccgctggtgccgcaggtcagtttcgccgatcttgacggaccgacctggctggcggtagatgtggaaccggcgcttcagttcacgacgggcgaattgcatctttaggatgccagcgcagcaagtttgccatcgcaaagagatatttttcgctggcttcgtcggaggagatgggcggaaactctgcggtgatgcaatgcaagttcagatctgcacaccaactgccgaaagagccaggcgtttcataaccgacgctggttaccagaggcaattcaaacgcctgagccagccattcgcctaattcgctgtgtctgggatcttcaatacaggccagtggatcgtggaatgagaccacccaggcaggttgaatgcggtgtataagctggcacagcgcctgggtttcaggttcggagccaggtttgtcacctgtcagtaatacgacatcgcgttcttcagcggcgctgttccagcgataaacggtttcaccttccttccagttcgccgccggaaagtttctgtttaaatccacaccattagcattggcccgtaaccccaactggcagccgtcaggattcacacacagcaccacatgatgacggcgcaaagaaggtgtcaacgtccgcagagcacaggagagcgtgacgaccgaagagttttcatcaccgtgagtgccagccagaatcaaaccactttcgcggctggctgcaggggcaggaaaccagattaacggcgcgcccaataatgaacgtccgtaatgttctgttccgggcggaaatgcgccgcgttcggcgcgtgggcgggttacggtcatgatcgtctctggttcaggaagtattacaggcagtgttgtgcaaattttgcggattatcaaatccttttcttcaacgctatgtcatcgatcttgtatcacttttttgccggaagttgtttgcattttattagttggatagggtttgtggatttttgctggctgacgggcaaataaagtttgtttaatggtttgcttatctgccagttgattaatcacatggcgggctatctgaccgccagcaccaagaatcagtacatttttcatgaaaattatcccagattattggcagcaatatgccagtccatatcactattgcggatttgaatatgtttcattacagagtttcctcaaagaacggagctaatactgaaattgcttcagccacataggctttgccgtcataaagatccatatggtttgcgccttcaacaatgtgatagcgtttatcctggcttgatgctcgatcgtacaggtcgtcactcatccatttgctccctgcctggctgcccgccacaatctgcgtcggctgagtcaggtacacttccgccatatggtaagcatcataggtaataatctggttaaggctgcgcaaagtagcgtaacccggtgctgttggatactgcgcgcgaggggtgtggtaatactcccaggcctgacgcagttcttcgttcggcgcatcggactccttcattggtgccagtggcataatggcgtattctccgctgctaatatcgctggttctggcgtttgaacccgcttcaacgtatggcagggcatcaatagatttcacattgttttcccaaccattacggaatatcgaaccaatattgaccgcactaacggtaccgatggccttgatgcggcgatcctgaattgcagcattggctgtatatcctgcaccggcacaaattcccatcgcaccaattcgggtattgtcgacataagaaagcgttgtcaggtaatcaatcacggcactgatgtcttcagtacgaatgtatgggttttctaactgacgcggctcgccgccactttcaccttgataagatgcgtcataagcaatagtgacaaatcccttttccgccagttttttggcataggttccggccgtttgttctttaacgcccccacctgggtgagataacacaattgcctgatactgacgggtttcatcaaattttggagggaaatagatcactgcagacaaagagatggttggattattgctgttagtgaagctgactttattattcatcattccgttcctcatggagttgtcggttcgttttaacggttggtgatatcactatagatattgatcattaagttgattagacccaaaatcatgattagacctatcatttaaatgattaatagattgcatggagatactgaatgaagcgtgaagaaatcgctgatctgatggcgtttgtcgtcgttgcagaggagcgtagcttcactcgtgcagcagcccgcctgagcatggcgcagtcagctttaagccagatagtgcgtcgtatagaagaacgattgggattgcggcttctgacgcgaaccacgcgcagcgttgttccaactgaagcgggcgagcatcttttgtctgttcttggccctatgttgcatgacatagattcagccatggcatccctgagcgatctgcagaaccgcccatccgggacaatacgtattactactgtagaacatgcagcaaaaacgatattgttaccagcaatgcgcacattcctgaaatcgcatcctgaaattgatattcagctcaccattgattatggtttgaccgatgtcgtttctgaacgttttgatgcaggcgtccgtctgggtggggagatggataaagatatgatcgccattcgaatcgggccagatataccaatggctattgttggctcaccggattatttttctcgccgaagtgttccaacgtcagtgtcacaattaatagatcatcaggcaattaatttgtatcttcccacatcgggtacagcaaatcgctggagattaatacgcggtggacgtgaagttcgtgttcgcatggaaggtcagcttttactgaatacgatagacctgatcattgatgctgcaattgatgggcatggattggcgtatctaccttatgatcaggttgagcgggctattaaagaaaaaaaactgatacgtgttttggataaattcacaccagatttacccggttatcacctgtactatccacaccgtcgacatgctggctcggcattctcattatttatagataggctgaagtataaaggtgctgtttagcactacttgctgatacattaatttaattcttctcttaacgtattctcagttcctttcaacgttttggtcattttttattcttcgtacaatggcgacagatgctgattatgataccgaaaacgggtttgaacgtgcgaagcccgaacgtagtgttcggagttctatgtgctttaccgcattttggagactattatttacactaaatctgatttgatatattgatacttaaaacatttgatgcttcctttgtcacttttttgatggaagttgtttgcatttctttaaggcgaaacaaataattacgcatcaattttaatgtcggttagagggaaacttatgaagcactctgtttcagtcacgtgttgtgcgctgttggtcagcagcatttctctttcgtatgctgcagaagttccgagcggcacagtactggcagagaagcaggagctggtgcgccacattaaagatgagcctgcgtcgctggatcccgctaaagccgtgggcctgccagagattcaggtcattcgcgatctgtttgaaggtctggtgaatcagaacgaaaaaggggagattgtccccggcgttgcgactcagtggaaaagtaatgacaaccgtatctggacttttaccctgcgcgataacgcaaaatgggcggatggcacaccggtaacggcgcaagattttgtctacagctggcaacgtctggtggacccaaaaacattgtcgccatttgcatggtttgccgcgctggcgggaatcaacaacgcacaggcgattattgatggtaaagctacgcctgaccagcttggcgtcaccgcagttgatgcccatactttgaaaattcagcttgataaaccgttgccgtggtttgtgaatttaaccgctaactttgccttcttcccggtgcaaaaagccaacgtagaaagcggtaaagagtggacgaaacccggaaatctgatcggcaatggcgcttatgttcttaaagagcgcgtagtcaatgaaaaactggtcgtggtaccgaatacccattattgggataacgccaaaacggtactgcaaaaagtgaccttcctgccaattaatcaggaatccgcagccactaagcgttacctcgcgggggatattgatatcaccgaatccttcccgaaaaatatgtatcagaagctgttgaaggatattccggggcaggtttatacgccgccgcagctcgggacctattattatgcgtttaacacgcaaaaagggccgacggcagatcagcgcgttcgtctggcattaagtatgacgatagatcgccgcctgatgaccgaaaaagtattagggacgggcgaaaagccagcgtggcattttacaccagatgttaccgcgggatttacgccggaaccttcgccgtttgaacaaatgagtcaggaagaactgaatgcgcaggcaaaaactttgttgagcgcagctggttatggtccgcaaaaaccgctgaagctgacgcttttgtataacacttcagaaaaccatcaaaaaattgcgattgctgtagcatcgatgtggaaaaagaaccttggcgtagatgttaaattgcaaaatcaggaatggaaaacctatatcgatagccgtaacaccggcaattttgatgttatccgcgcctcgtgggtgggggattataatgaaccctccactttcctgacattattaacgtcaacgcattcaggaaatatttcacgctttaacaatccggcatatgacaaagttctggcccaggcatcgacggaaaataccgttaaagcgcgtaatgccgattacaacgcggcagaaaaaatcctcatggagcaagcaccgattgcaccaatttatcaatataccaatggacgattaatcaagccgtggctgaaaggttatcccattaataatcctgaagatgtggcgtacagtcggactatgtatattgtgaagcattgatgtgatgggaactggcgttacccttgtgcataacgccagtgatgtctgatttagcgaccctgttccggcggtgtaatgttatccatatacagcgtctggctggggaaggcaaagtccgcgccgtgtgactgtacaatatcgataatcttcaaataaacgtcttgctgtgcagcaagccattcagcccataccgtggttttggtaaagcaataaaccataatattcaatgaagagtcagcaaactggttgaaataaaccagtaaggtttgtcgctggtcgatggccgggtgatttttcagcatctcacgtacagcttcgacaataacgcccacttttgccgcatcctcataacgtaaaccaatggtcgtggtaatgcggcggttggtcattcgtcctgggttttctacgctgatcgacgaaaacagcgagttcggtacgtacaatggacgattatcaaaggtcgtaattttggtaattcgccagccaatttccgctactgtaccttcgatatttctgtccggtgaacggatccagtcgccaatactgaaaggacggtcgaaatagagcataatcccggaaaagaagttactcagaatatctttaccggccataccgacagccagaccaccaataccaccaaaggtcagcaagccagaaaggctcatgccgaaatgttcgccataaagcagaacaagcaccacaataatggtgattttgatgatacgcgacataatccgcgcactggtgatatcgcgaccttttttaatctgctgtttttcaaactgattaatcagcagaaatagcttaatcgtcagaataaccgcaatcagggacgtacagataaaatcgataacgcctggggtgataaatttgagtttatagttttctataacataattaataatgctaccaacagcactgataattatggtgtagattaaaaattgcaccgcatggaataaaaatccttttcttttacgatttccacggcgaaaccaaaagctcatcagaatcaatgctgcgcagctaccgaaaataatgaccagattaagcgcattatttgtaaacagttcagcgatcattgttttatcaggctcctccagataattgtcgtcatgccggaaacccctggcggggctattttaccgcgacaattcattcagatcatcaatagtcagggaaggaagtagcaacattagctaaggaaggtgcgaacaagtccctgatatgagatcatgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaaaaactggggataacgccttaaatggcgaagaaacggtctaaataggctgattcaaggcatttacgggagaaaaaatcggctcaaacatgaagaaatgaaatgactgagtcagccgagaagaatttccccgcttattcgcaccttccctaactaatcaatgcgttgattgtaaatccagctaagaggtgaggttttcagagcagacaacggtgaaatgtcatggtattgttacgtttaggtaacaagaaatttgtctgcacaaggattacatcatgattatggcgaaactgaagtcagcgaaagggaagaaatttctctttggtttgttggcggttttcattattgcggcgtcggttgtgactcgcgcgaccatcggcggcgttatagaacagtacaatattccgctgtctgagtggacgacatcaatgtatgtgattcagtcatcgatgatttttgtttatagcctggtctttactgtgttgctggcaatcccgttgggaatttatttccttggcggcgaagagcagtaagtaaaaaataggcccgataactcgggccttgtcagttattgaagagtcgttaatcgtcttcttcgtcatccagttcaacgggtgtctgatactggtcaggtttaatgaccagcaggtcgcagcgaagatgatcaatcacctgttccgccgtgttgccgaggaatgctgctgaaataccggtgcgtcctaccgtgcccagaaccacaatccccgcctgtaagtgctccgccaaatcaggaatcacctcttctggcagacctttttctacgtgcgtcatgttttcattaatgccgaatttctgccgcagggctttcattgccagcaaatgttgcccacgaatggcatcgttataaacgctcgggtcaaattccggcagttcaatcgcgatattaattggcgttaccggataagcgccaaccagatgaacttcggtatggttgacttgttctgccagttcgatcgtctctttgaccagtttttcattgagcgcattatgatacggctcttcactggcgagattcaccgccaccagcgccttgcctccttccggccacggctggtctttcaccatccacaccgggcttgggcatttgcgtaacagatgccagtccgttggcgtaaaaatcaccgcttccagacggtcatgttggtgcgccatttttagcaccaaatcgtgtccgccgctgatcacttcctgaatgatggcttcgaaaggacggttatgccagaccactttaatttcaatgggaacgccagcattgagataatattttgcctgctcgtggatccaggctgtacgctggctgatgacgccctgacgcatagcggtacgttcgtccggggagagcagggtggtcatttcgtatgagaagtcatagatcggcaaaaaggctttaattttgccaccaatccgttgatgtaaataaacagctcgccgcaatgctggttggtcgtcctggttaggatcgataacaacgagcatgttctgatacatagccatacagggtctccttacaacaactgtcaacgcagtttgtaattaaaagattaacccatatctggtgaatgaaacagtgatgaaccttctgccagatcaataaatcagaaaaatttaatgatatgacagaaggatagtgagttatgcggaaaaatcaggcaacgttacgcgtatgaccagcaagctgggccagcgcatcgttattttcgatggtgatgtatttacctttgactgccagcatgccgcttttctggaagcgacccagcagacggctgatggtttctaccgtcaggcccagatagttaccgatatcgccacgagtcatcgtcaggcggaattcacgaggggagaagccgcgttgggcaaaacgacgggacaggttgtagatgaatgcagccagacgttcctcggcatttttcttcgacaacagcaggatcatgtcctgatcgcctttgatttcaccgctcatcagacgcatcatctgctgacgcagattcggcattttaccggacaaatcgtccagcgtttcgaacgggatttcacataccatcgaggtttccagcgcctgcgcgaagctcgggtgatggccgctgccgatggcgtcaaatcccaccaggtcgcctgctaaatggaaaccagtgatttgctcgtcgccttgctcagtgatggtataacttttaatcgtaccggagcggatggcataaagcgatttaagttcatcaccagccttaaacagcgtctggcctttctgaataggcttcttccgctcaatgatattatcaagctgatcaagctcatgttcgttgagtgtgaacgggatgcaaagctggctgatgctgcaatcctggcaatggatagcacaaccgccagactgaatgcgccgtataattcgcttttccgggatcataggtctgctcaagccgtaattgatatttgtcaattttaacatctttttagggagcaagtaagtctaagcaaaccttaacagcagagaattccgatattagatgtaaatatatgtctatctatttgaaaacccttaagttgttaagggtaactttacataaaagtgtgaacaagctggcacaaattgtttaatgtttacagcaaaagataaccttcatggcgcaataaccactcttttcgctgaactccgcctgcatatccggtcatggtgccgtttcggccaataacccgatggcaaggtacgacgatgctgatgggattcgatccgtttgccgcaccaacggcacgcgccgcgccaggacggcccaattgctcagccagttggccgtaatgcattacctgcccgcaggggatagtgcgtagtgttttccagacttcgcgctgaaatggcgtcccccccgtagcagtgggaagcgtatcaataatgctaagattaccggcaaaatattcacgaagcttgtcgcttaaaccgcctggattggtggcagaaatgcgctcatagccttctttgcgataatggatgtccagcagctgcaccatgcgttcgctgtactcttcccattcaaccgcccgcaggcgaaattgctcatcgcaaatcacccacagtggacccagtggcgtggcaattttttcttcaagtaatctcagcatccgttctctcttaagacaaacgtgggtaaatacccggacctatcggcagaccgacaagataccacgccagcaacatcagcagccataccaccaaaaagataagtggatagggcaagactaacgaatagtaagtacccagtttcgcgtctggtttgtagcgttgcaggaatccaagaaacagtggaacaaaaggagataccggcgctaaaggcaatacggatgagtcggcaatacgaaagaggatttgcgcaaatgccgggtgaaagccaagtagcataaacattggtacgaaaatgggggcgagaatcgaccagattgcggaaccgctggcaataaacatgcataagaaagaggaaagcaacgccagaccgacaaacgccgggatgccgctaagccctgaactttccagtatatcggtcagccccacggcgatgaatttccccatgttgctccagttaaacatggcgacaaattgggcgaggggaaaaaccatcacgataaatcccgccatctctttcatcggttcaatcattaaatgcggtaaatccgcctgacgtcgaattgtgcgggtagcgatgccataagccagcgagacaacaaagaaaaaaagaatgatcagtggcacgatacctttaataaagggtgatggcatcacggtgtgattaatcggatcgcgcaatatcccgttttgcgggatcaccatcagcgcaatcgcagcaataaaaagtagcgatacgacacctgctatgcgtaaaccaaaacgctgactttcggtcaatgtctgcagtttctcatcgctgtttccctgccattgacctaaccgtggctcgatgattttgtcggttatcaggccgccaacaatcgtcagtacgactacggagctggccataaaataccagttatcaattacactgacgtgcatttgcggattgaacgcagctgccgcttccgtgctgatccccgacagcaacacgtcggttgtgacaatcagtaaattagccgtaaagccgcaacctacgcctgcaatggcagccagtaaacctgcaactggatgcctgcccaccgccagaaaaatcagcgcacccatcggtggcatgatcactaacgccgcatcggaagaaatgtggctgaaaaaagcaataaacagcaccatataactggcgtagcgggcattaacatgcgatgccattttaaccattagtgctggcagtaagccgacgcgctccgccagaccggcacctaaaaccagcgccaggatcgcaccaagtggagcaaaaccgctaaagtttttaataacattgggtaaaaaccagtgtaatccttccacactgagcaggtttttcaccacgaccggcgtaccatcggtcgggtttttcgcactgacgccaaaggccgacaaaattgccgtcgtcaccatgagtacgataatcaaatagataaagagcagaaaaggatggggaaccttgttaccaattctttcgacccagccatagagcttcccggattgggaggacgacggtatggatgacatactcatgggcattcctcggttgttgtgtttgcgttgttgttgttattttaaaggtgacggtgtcacgtttttcgggatagggcagtgatacggttgcgtgtccgttacttgctgatgctcttgttggcattcttgcaatagccctgaatcaaggaagagattgactgtggttgctgccatagttttcgccgccagcagcattcctttatgagcaatagatgttcgcccctggctaaccagttgccacgtatgtagcggtgtaccgacggcaaaacaggggctgaaacactgggcaacaggcagtttccaactgacgtcgccgacatcagtcgatgccgcaagcacgttatcggtggcggcatatggagcgacttcattcgccagtaccgtttcacgatgacgtagtgcaaaaaccttgccgttttcgccaccggttgcggcgatattattcagactgttttgccgatcgttggaggtgagcgtagcctgaatttgtttcgcaaaagccagttcttcggagttccattccggggtaccaaaatgggatagggcctggtacatggcattttctaaggtgcgattcgggagataactggaacaggctttgtcgaagcggcattcaaccgtggtttcggtcatcaatgccgcaccttcggcgattttggcgacccgatcataaatatgctgcacgtcggtcatttcgggggcgcggataagataaagcacttctgcctgcgcctggaccacgttgggcgagatcccgccgctatttgtgatggcatagtgtacgcgcgctttttcaataatatgttcgttgaggaagttggtgccagtggtcatcaacgttacggcatcaagggcgctgcgtcccaaatgaggggaattcgcggcatgtgctgcgatccctttaaagcgccatgatgcctgaatgtttgccagcgtgcgggtattgaacataccggcaaaggcttccgggtgccaggtgagtgccgcatccacatcatcaaataccccctcgcgaaccatgaacgttttacccgagccgccttcttcgccaggacaaccataaaagcgcaccgtgccgccttgcccatattgttccagccatttcttgacggctattgcagcggcaaaggcggcggttcccagcaaattgtgtccgcaaccgtgaccattttcaccgggcgtcacggatgtaggttgcgcgcaacctgcttgctgacttaaacctgccagggcgtcatattctcccagcagggcgataaccggtttgccttgaccaaacgaagcaataaaggcatttgggatattgcctacgttgcgggtaacggtgaagcctgcagattccagcgccgaagccagatgctccgctgaccagaactcttcaaaacgtgtttctggatgatcccagatttgatcggcaatatcggtataacgttggcgatcggcttcaatcgcatcgtcgataaaacgatagatttcctgcatcagatacctcgcgtccagggaaaattgagcgcggtgcgcgccagcgtttcgacggcaatagcgagaacctgctcgtcaaaatcgaatttttcgttgtgatgacctgccgccagctgtgtgccaaacaccacgtaggaggcttgcccttgatgttgctgcacgcgggccatcattaatgtggcatcttcggaacccgcaggcgcttcaacacgttcaatggcctgattgacccccgcgacctgagccgcctgactttgcaaccatgcgacccattgcggcgaaggagaactggcggtagctgcacccatcagacgagtttcaacgccgacaccatacatggttgctgcgccctgaatcgcttgttgtgcacggtcaaaaacatattgattaatgacgtcgctggccccgcgtgtttccactttcagcaacgccgaggcaggaacaacgttacgaccgcttcctgcctgcataacgcccacgtttactctggaagctccttcgctgtgcggggcgattgcatgcagtgcaagagtggcttgtgctgccgccaacaaggcattgtgaccgtcttctggttttgcgcctgcgtgagcggcggtaccggtgaagtgcgcgtcaaatttggtggttgccataaaattatcactgccgcacaccacggtgcccgcaggtacgccagtgccaatgtgcacggcagtaaaataatcaacatcatctacgacacctgcatcgaccatcgcccgcgcgccacgcgtaccttcctctgcaggctgaaaaatcagtttgatgacgccatgtagtccggactcgaactgtttaagggtatgcgccagcccaagcccaatggcggtatgtccatcatgaccacaggcatgcatcattccggcgttacatgacgcaaaaccgtcgcggtaggggcgatggctgacatcctgctcttcactgagatccagcgcgtccatatcgacacggaaagccatcaccggaccggggcgaccggtatccagggtggcgacgataccagtgaaaccaccttcaaaagccgcaatccattgtgctagcgcaccctgttgacgagcgcgctcgaattcgcgttgtagagtgaattcatcaggtaatcccatccggctactttcattaactacttcgcgacccagcgccagtgaatagccgagctggtgcaattcttccgcaacaagggtggcagtgcggaattccacccagccagactctgcatagtgatgaaaatcacgtcgccagtgcgataattttggggcaagcgaattaacaaattgattcaaagactccataacctttcccgtcatcagtaaaaagtgtgacccggttcacgtagcgatagtttttacttatcactaactgatttttcacagttttaaccgttcataaattaccctgacacaatcatctgcattaaagtagatgccagtttctttggtctgataaataacggttatcggtggcgtcatggcttttcaggtaaaaattcatcaaattcgggcttttgttgaagtggctcgtcagggcagcattcgcggagcgagccgaatgttgaatatgtcgcaaccggcactgagtaaatctattcaggagctagaagaagggttagcggcgcaactcttttttcgccgtagtaaaggcgtgacgttaactgatgccggtgaaagtttttatcagcacgccagtctaattcttgaagagctgcgcgcagcccaagaggatattcgccaacgacaagggcaactggcagggcagattaatatcggcatgggggccagtatttcccgcagtctgatgccagctgtcatatctcgttttcatcagcagcatccgcaggtaaaagtacgcattatggaagggcaactggtgtcgatgattaatgaattgcgtcagggagaattggatttcaccatcaatacctattatcagggaccgtacgaccacgaatttacttttgagaaattactggaaaagcaattcgcgatcttttgccgcccgggacaccccgccattggtgcccgttcgatcaaacagttactggattacagctggacaatgccgacgccacacggcagctactacaaacagttgagtgaattgcttgacgatcaggcgcaaacgccacaggtcggtgtagtctgcgagacgttctcagcctgtatcagtctggtggcaaaaagcgattttctcagcaaactgcctgaagaaatgggctgcgatcccttgcacggacaggggctggtgatgttgccggttagcgaaattttaccgaaagcggcctattatttgattcagcggcgtgatagtcgccagacaccactgaccgcgtcattaatcacgcaattccggcgagaatgcggctatctgcaaagttaaaactgcataaaaaaatagagtctgtcgacatccgccagactctacagtacacacagcagtgcatccgcgtcttaaatccggcattgtctcctctgcgccggtgactgtgttataacggttttaacctttagttgccaattttcttcagtgacagatttcacgaaaatataagttacattattaatatcgtgaatgaataatcatgcataagtattttgcttaaaatatcggcaatatttggaacttattactggaaatttgggtaatacgttgttggaccgacccggtctggttatcatatcgcgctcttaattgcgggaggatgtaacatgaaccttgacgacaaatcgctgtttcttgacgccatggaagatgtccagccgctgaaacgtgctaccgatgtccactggcatccaacgcgtaaccaacgtgcgccgcagcgtatcgacacgctgcagcttgataatttcctcaccaccggatttctcgacatcatcccactaagtcagccgctggagtttcggcgggaagggttgcaacatggggtgctggataagctgcgcagtggtaaatatccgcaacaggcgagcctgaatcttttgcgccagccggtggaagagtgccgcaaaatggtgttcagttttattcaacaagccctggcggatggtttgcgtaacgtgctgattattcatggtaaagggcgggatgataaatcgcatgccaatattgtccgcagctatgtggcgcgctggctgaccgaatttgatgatgttcaggcatattgcaccgcgctaccgcatcatggcggcagcggggcgtgttacgtcgcactacgtaaaacggcgcaggcgaagcaagaaaactgggagcgccacgctaagcgcagtcgttgatctcgagacgcatccgcggcttatgccgccagcacgcggttgcgtccatcatttttcgcccgatacaaagcatcatcaacgcgtttaaacagttcatcgatgctttcatttccttcgtgatgcgccacaccaatgctgacggtaaagcgtggtaagcccgaaatactcacttttgccacgcttacgcggatagtttcagccagcgaaagcgcggtatccagtggggttcttggtagcaataagacaaactcttcgcctccccaacgaaacaccaaatcgcctttgcgagcgcaactttcgagggtgcgggcgagggcgcataacacctcatcacctttagaatgcccatagagatcgttaatgtgtttaaaacgatcggtgtcgatgagcaacaagctgtaatcctgagcgatggcgagatgctgcatttggcctggttccgtaatgtgataaaactgtcgccgattcagtaatccggtcatcgcgtcatggtgagcagcatgttccagctgctcctccagccgtttttgctcagtaatatcatgcacaatacataacatgagcttgtcgccataaatttcaatcggtccggcataggtctgcacatgacgagtcgaaccatccgccagtttatgaacaaaattcaaaggtttatgaccaccgggtaaatgcgagatttcatgcatgataggcatgacgcgacgcccgagcatatttatttcccaggtatgtttctggcacatcgtttcatggttataaccatagaaattgagcgcggcgaggttagcatcgacgatttgtccatctcgtgacgggtcaatcaacaacattggtgcagagttagtcagaaaaaagcgcgcataaaaaccttgttttttgcgctgataatttgccgagcgactggcttttaaacccagcgttgccggcgcttcgataccttcgaaaataatcaccggttctgtttctgtcagctttcgcaaaacaagccgacagctcaatgctgtttcctcttctttacgctgaacagtgaggatttcgataatatcgtgttggttttgcagatcggagaggtatttcggcagttctttttgtgaggagacggaatagggtccggttcgtagctgactaaacgtgaggtcttgcatcaacagtttcgccgcgctattggcataaattaactgttcctcaaagggcgaaacgatccagacaggactggtgagtaagtccagggtattgaagttgtgcgtaatcattgagatcccgttatttttatcaatttttgttgctatccgatcgcaaaaaagccacgtcatatgatcagataattctgataatgatagacgctatttaacacttcacacggtttgtatacggaaaagcattttgctttttgtattcaatttagacagaattttattaatcatttcagggtaatggggtgatgagatgttgcgtaacagggccagaaggctagactacaaaataatgcgttgatgatggaggcactgtggaagcgattaagggatcggacgttaatgtcccggatgcagtatttgcctggatgctggatggtagaggcggcgttaaaccgctggaaaatacagatgtgattgatgaagcgcatccctgttggctccaccttaattatgtacaccatgatagcgcccaatggctggcgacaacaccgctgcttcccaataacgtacgtgatgcgctggcgggcgagagcacgcgtccccgagtcagccgtctcggtgaaggcacgctgattacattgcgctgtataaacggcagcaccgatgaacgccccgatcaactggtcgccatgcgtgtatatatggacgggcggttaattgtttcgacccgacaacgcaaagtgctggcgctggacgatgtggtgagcgatctggaagagggcacgggtccgaccgattgcgggggatggctggtggatgtgtgcgatgcgttgaccgatcattccagtgaatttatcgagcagctgcacgataaaattatcgaccttgaagataatctccttgatcagcaaattccaccgcgtggattcctggctctgctgcgcaaacaattaattgtgatgcgtcgctatatggcaccgcaacgtgatgtttatgctcgtcttgccagtgaacgtttgccgtggatgagcgatgaccaacgccgtcggatgcaggatattgccgatcgccttgggcgcggccttgacgaaatcgacgcctgtatagcacggactggcgtgatggcggatgaaatcgctcaggtgatgcaggaaaatttagctcgtcgtacctatacaatgtcgttgatggcaatggtctttttacccagtacctttctgaccgggttatttggcgtcaaccttggtgggatccctggcggcgggtggcaattcggattttcaattttttgtattctgttagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttgcaggtgaatgcaacgtcaagcgatgggcgttgcgctccatattgtcttacttccttttttgaattactgcatagcacaattgattcgtacgacgccgactttgatgagtcggcttttttttgcctgttatttatcagcgtctaccctttaagagtccacccaatgaccagagggaaatatgacgacacttatttatttgcaaattcctgtccctgaaccgattcctggcgatcctgttccagtgcccgatccgatccctcgcccgcaacccatgcctgacccaccacccgatgaagaaccgattaaattgtcgcatcgtgagcgtagatctgcgaggatacgcgcctgctaactttgcgtcgatgaccacgagaatagattgtgaccgctttttctaccctgaatgttttgcctcccgcccaactcacgaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttgcaacatgcgccgcatattatcgtggcaacgccggggcgtttgctggatcacctgcaaaaaggcacggtatcactggatgcgttgaatacgctggtgatggatgaggccgaccgcatgctggatatgggatttagcgatgccattgatgatgtcatccgttttgcgcctgcatctcgacagacgcttctgttttcggcaacctggccggaagccatcgctgcaatcagcggacgagtgcaacgcgatcctttggcgattgaaattgactcaacagatgctttgccacccattgaacaacaattttatgagacatccagcaaaggcaaaattcctctgttgcaacggttattaagcttgcatcagccatcctcttgcgtggtgttttgcaataccaaaaaagattgccaggctgtctgcgacgcgctgaatgaagtagggcaaagtgcattgtcattacacggcgatttggagcaacgcgatcgcgatcagaccctggtacgttttgctaacggtagcgcccgtgtactggtcgcgactgatgttgctgcgcgtggtctggatattaaatcgcttgagctggtggtgaactttgagctggcgtgggaccctgaagttcatgtacatcgcatcggtcgtacagctcgtgcaggaaatagcggtctggcgatcagtttctgtgctccggaagaagcacagcgggccaatatcatttctgacatgttgcagataaaacttaactggcaaacgccgccagctaatagttccattgcgacgctggaagcagaaatggcaacgttgtgtatcgatggcgggaaaaaagccaaaatgcgcccgggtgatgtattaggtgcactgacaggagatatcgggcttgatggcgcagatattggcaaaatcgccgtgcatccggcgcatgtctatgtcgcggtccgtcaggctgttgctcataaagcatggaaacagttacagggcgggaagattaaaggaaaaacgtgccgggtgcggttattaaaataatgaaatgttgaattgccgggtgcaagagtaaacatcttattcgggattgccggatgcgacgctggccgcgtcttatccggcctccataagagtagcccgatacgcttgcgcatcgggcgctatcctggttatttcacttcaaccacattcagccgtaactcatccaactgattttcatcttcttctggctgccagcacgccggttgtagtgggatctcttcgcgatcaaacgccagatcacccccgttaaccacttcagaaccgtgggtgatgcctttgaaatcgaacaggttggtatcgcacagatgcgacggcaccacattctgcatcgcgctgaacatcgtctcgatacgccctggataacgtttatcccagtcacgcaacatgtcagcaatcacctgacgttgcaggttaggctgtgaaccgcacaggttgcacggaataatcgggaacgcttttgcatcggcaaatcgctgaatatctttctcgcggcagtaggccagcggacgaataacgatatgtttgccatcatcgctcatcagtttcggaggcatacctttcatcttaccgccgtagaacatatttaagaacaacgtttgcaggatatcgtcacgatggtgacccaacgcgatcttcgtcgcccccagttccgttgcggtacgataaaggataccgcgacgaaggcgagaacacagtgagcaagtggttttgccctctggaatcttctctttcacgataccgtaagtattctcttcaacaatcttgtactcaacgcccagcttttcaagatactcgggcagaacgtgttccgggaagcccggttgcttttgatcgaggttaacagccaccagcgaaaaattgattggcgcgctttgctgcaaattgcgcagaatctccagcatggtatagctgtctttacccccggagaggcaaaccatgatgcgatcgccttcttcaatcatattgaagtcagcaatggcttcgcccacgttacgacgcagacgtttttgtaatttgttcaggttgtattgttctttctttgtaatttgttgattttcttgcattatttcagttctctggtactaaatggggcaaattgggggcaaactttgcaactacgataaccgcgcattcaacatggctatctgttcgtcgttcatgtcatcaatccacataccgtaaatttcatacaccatctgcgcagtttcatgccccatttggctggctataaatgccgggttcgctcctgccgtcaacagccagcaggcaaaagtatgccgcgtatggtacggattacggcggcgaataccagcacgttttactgctgcattccaccttgcccccaaactgcttaccgagtaataaggtttttgttttccgttacacaccctgggcatgaaaacaaaatgcagtttttgcttttcggttctgccgtactcccgatgataaaaggtgatttcgcttttgcgatgatgcccggtcagtttgtattgctccttcagtgcttcaagagcaggctgcagtagtgttactgttcggatcccggcatttgtttttgggggaccgaacatatcaagtatcgtcaggtttcttctgacattcactattcccttttcgagatccacatcctcccacgccagagctgccagttccccgtgacgaagtcctgagtaaacggcaaatttccacaagttctggctctgtcctttttcactttccattaatgcattgaattctgttttagataacggatcaggctttattctgtttcgctgtaatttttttactccttcaaatggtttggttgatataaatcccgactgatacgcaaaacgcaacagcgaacagagcagggcgatatagttatcaactgtgcgcacggttcttccttttttgttggatcttggattatccaggtaaagcgtttctccatgcagcagttcattccggtagtttaagatatcgctataacgaatatgtgatatcggggtactttcacaaattattattctgagtgtttttaattgtgatttcgttttcttcattgtgtttgttgttaactctgtctctttaatttttgtccagatatcacaaagctctccgaacgtttttatgactctcgttgtcaccatttttgccccagtgctggactggggaaaacgtcttaaatactcaaattcaccggagtttatttcatgaactatcagcgctcttaaatttccggcctttttaatattactgtttgtaatctcccagccttttaatgtttcccgacatcgttttcctcgaaacatgaaccagatgcgaatgtatctacctctaatctcgacacctgttggtaatttagacatatcatgagtctttgataaactgatttatctttggatagttgtaccagataatccctcgtttgctgtctggcttacctaaaggagatactcgtttgaagtggaagccctccacccaacagttctggcggtatgcttcaatttgtctggcccccagaccagtgcgaagcatcaggccgtattcaaccatccactcttcattaaagattacttgtgccatcgcatcacctctggcaggcgccaatgttagactgaaattgacgcccgatgttgattattaataatcagctatgaagttttaatttgaatacaatgcaattctcgaggactgaagtttctcgcaattaaaatttatcagttttactttctgctctctggaaacgcctgcttcttttttacctgagagcattttttcgcattctgatttcgttagtttagattttgaatatcttgtccagttagtaggagtgccaccttccttttcaatagtggcggtaattttatacatgaacacctccattattatttccagtggttcgtttattccatctttcgagtgcttctttttcacttccaccataaccggttcgggattcgcatccgttacacttcgctcggtaatatcctgaaatggctttcaccgttactgatggacaaccacaaaatggacatggtttaacattgtcatatctcataatttttctcataaaaaatatttcaagttggcggtgcattacaccgccaggctgaattattcctctgaattatcgattacactgtattccccggttaatacagaggaatctgcaggatcgattgtcagtggttccttttcatccattgatactgcacgctggatctcaattgatacgggcaaatatttgaacaggcgacgaatagccgttttctttgccatttcttcccagtgagttacccacggcccgttattaccagctttactcaggctgcgcaccagctcaatctgtttgcgcgtcataacttcaaactgagtacctccgtctttcagtcttgcgacagcatagacgtgggtaaccggggcatcttcgttttctcccgggcggtgtattaacttttcatcaaggccaaattcgaagctaaactcgtcaccttcacggacaacacgggctgacaggctggcgatttgaccagaacggcgagccagatcaatcatgccgcgatagccaatgattagctgaacgttctttttaccgctcttttcgtttttattaccaaaaggcagtaaatatgcatgaccgagggcgctacctggctcaagtccgagctgtgaacactgtacgatcgcactgacaaaactcatagtgtcacagtttcctaacgccggaactttacgaatttctgtggtggcgatacggatcatacgttcagccgtcatatggcgtggaagagctgctgccagttgctctttcattgatggctggttaataaaactaatcacgtcgctatttttaactgctgctggtgcacggtttccctgagttttttgcagatcggcttttgcgattggtggttgcttagtcatttgcatattccttagcccagcggggcagtgataatgtcttaatagctggccattcatcggtattcaggcagtcagacagggttcgcagattgcggtgatattcctgttgacctgccagttttgcttcttcgcccatcatgaaaatttcaaccggataacgtccgcattcaatagttgtgctggcaaccagaaaaacgaaagttggctgcactccaaactgtgcttcataaccgtcactgtagaatgcatcctgaacgtgatagcggtagtcgtaataagcggttttgaatcgttgaatatccgccgtagttttcacgtccatgatccagtgaaattcagggataattttgtccggacggcaccgacacaaaattcctgtttcaggatcttcccagtaaattgatgattcagcgtgtccggcgctttcaacaagccattgccccagcggcaaagccataacgctttgatacatgagttcaattttccggccttcttccgcagtgataaccgtttttcctgtgcttgcgcattccatcagaaacgctttctcttcttcttttccggcgtttgtacggcggttaaattcaggtgctacgataaagcggttactgaattcttccggttcaagtacccggcagtggaaagcagttcctaaatcgagcgtttttgtctttgtggtgtccacgggggcatttttacgccacaaatatagtgccggagtatcagcaatgtcatcgagctgagacttactgataccgggacccgcgtggtaattctcattcgaaattccgtaataaatacctggctctatgtcttctacgattacgggatctgcgacttcgccagtttcatcactgcaatcgcgatgcggatcgctgccagcattctcattgtgcggatgttcagcgccttccatttcctccggatcattttccttagcttcaacctgactctcttcatcgaatgtttcctggtatgttgcgtcgcccatcaccgcaccacagtcagggcagttatccccgccagtctggccgcaggcattgcaggctatttccggttcctgttgcactactggctcaggttgattcatatctgggctggttttttccgtttctggctggttctggtacacacaatcgcgagtctggatcccctttacccatttcggatcgttcgggtcgctaattccgtcaacaaattcaccacgtgatgcagcaagcaatttatcgtcatcgacaggattttttgatggaatgtttttccgggcttcatggagttctgcccgcagttcctgatatttcgcatcaacagaatttacctgtgactgagcatccagcggctgcgtgtcctgatgatgttcagttgcgtccggttccattgtttcagcctctccctgttcaactgccgttgttccagatggttgcggtttttcttcatcatcctgttttccttcttctgttactcgctgcggcatcggggcagaggagcgaccgcaggcaatatccacgatttccggatcagggttggcatgatcggtttcagtcagtactttgttcagatattcagtgacgtgcgcggggatgacctcgatcccaattggtgcttcttttacggacgcaaccacgatggcgcgggaataatccagcccgccaggcatggtgatgaatttgtcgcggaaaacagaaaagggcggtttattttcagcgataatttcctcaatgcgtttagcgtgtgccggatgaaggttatagatgtccagatccattgaacgggccagtacgccagtggctacgtcgcgcgccagtgacgtcagatcgtgtacgaaaccttcgccgcgatcggtgaggtttccgccgccagcattagcaccggaagccgtgcgagtgatgtgtgaaacacgattacccttcatccactcttttgtcagcagtcctcgatcggtgtagtcagcgttcaggtatgcttcgaaaaaagcagttatcagtcccaggtttgaattaccaggattagggaaaactttgtcagtgtcacgaaccagtttgtggagttcgcgaatttccagcgggtcgagcaggctggttttgtgggaaacagccagggcagtaacagccggtagttcttcagcccgagcaatgtgtaatgcctggagtccgtcgcgtgaaacgtgcgttaccggtttttcgctgccgtgttgagcaagccaacgaatgggcagttcctggccagaaattgggagtagcatattctcctcaatctcagtcatgtcttcgccgttgacgttggtattgccttgatagtgagcgttgtctggtgctgctcccggttttagttcccatgtcatggagtctttgctgagttgatagcgttcactccaggtaaaatcgatctcaccttcagcgggcaggtcattaacgacaggaaaattcgtggcaacagctttaaaatagctgctcagttttttacctgacttaacgatcaggtagtccagagtggcacaggtcgattcaaaatcgttgcttgcccacaggacgacgtcaggttcaccggatgattttttcgctttccgtaacaggaagagtggttttgtgctcattgttttttaacctcaactcagattaaaattcgttttgttcagtgaatgatcttgccggatacacactgttcatagcctgcgccatacgcaggctatttctttcagatttcaccttttaatttcattgcaattagagttgccagaaattcggcttttttttctgcgggcagattctttccgatatgcaccaggcacatttttttgacaccttcatcaagtgtttttacgttgcctgatggaccatcgatatcaaccacagtgaatggggtttctttattttctgttttaattacgtagccaatgcgctttccttccagattcacctcgtgaacaatgtcatcggtagttacaacagtggcttcataattggtaatcatgtttttctccttaattaaggttgagcgaatacctgccatttctggcataaattcagtttcgaatagtcaattaattaaagttcatgtgccatctggtctttttcggcacaagcttcactgcaatattttctcggttcgtcttttgataaaatcccgtgcatgaagtgaagcattctttcaatagctttgctttcttcaacgtcttttttgcaaaggtggtaagcacattttattttcttagtcatcaccatgactccgcctttacaggtaaaccatcacgaccgaggaagactttaatcatgcggtcagtaatgaatgtttttgtggtcaggttacgaatatatagttttcgctttttaatattgtttgccgaggcaatatatgtccggccttcatgaagaacataatcgccaggagtcacacactgacgtggtatttcatcagttccgaagtgatgtgcaatcataattatctccatttttacaaatgaactttgttgatgcggtgtctggtgcctccaggtgactgcaaccagttaacaattacagtcggctttcccacccaaaccaataaggactaacatgacttttaactgtgccacgtgcgcttagccgcattcaccgcatcacaaaattcactttaaaaagggcggacatcagccgaacttcaagaaaaaaactgatgccgccaggactacacacagcaatgtcgttatttacaaccggaggcgcactcccaccatttaaatttaacagacaagaccgactctttatggatatcggaaatgcgccttcgtgttgtgcccggttttatttcaccacctccgggcttcggtggtctcggctatacccctacagcgagagcttgtgttaacatttcaatacccttacagttgagagttattgatatgttggatgtatttactccattgttgaaactttttgctaacgagccactcgaaagacttatgtatacgattatcatttttggtctcactctctggctgataccgaaagagtttactgtcgcattcaatgcttatactgaaataccttggctctttcagattatcgtttttgccttttctttcgtggtcgccatttccttctcaagattgcgagcacatattcaaaagcattattcattactaccagagcaacgagtattgcttcgtttatctgagaaagaaatcgctgtatttaaagatttccttaaaacaggaaatcttattatcacttctccttgccgtaacccggttatgaaaaaattagaacggaagggcatcattcaacatcagagtgatagcgcaaactgttcttattatctcgtcaccgaaaaatactcccattttatgaagttattctggaacagcaggagtagacgttttaatcgttagcttactgtgtgcttctccaaccatcggcgcgcaccagtttcggttttaaatgttttgcttttggtatacgtcatggcagtgaacgttccatcctggttggggaacacgccgcacaccagggattcgttgttgccgaggtcgattttttgcattttgcgaatctcacatcttgttgctacgtatagcgacttctgcctgccagagatcccagtcgttgctgcgtaaagcctgcacagcctggttgtaagtgataccgcaacaatccatcaaatactgaactacttcgtaatgcaccatcttatctctccccttaacgccgggtggcggaactaactgctgcactgcaaaatttgaatcccgccgtcatgttcatacgcctcgggctggctacttaaccccttaccactgcctggtaactcgaagtattgcccggcgttctgtggggcggggtgggtggtatgctggaactataggtaatgcctaattgattgtcaataggctatgcctaatgttttgagcgtaacctaataggtgatggcgacagcagaaagtgatgggggggttaaataacggaatccaggagttttccgtcagaccatataagtttaagttccagtttttgtgatgttctggcttttccgttcagattcaagagctttcagatacttacccactttcatttccatcgctgctatgtaggcgcgaacatcgtggtcaacccaatctggttctgtagcatttccagataacaggaaagctacaatcgctcttatttcatcagaggctgcttgataaaggttgtttatatctaaaagttcactttttgtatctgaattggtgggggttggtatggggtattcgttaagcccccaatgctctggaccaacaacatcagaaaagaaacgccataattctggaagtttatctttacttatagagcctttcttaatccagtcataaattgatggtggttggactttaaagtggcgtgcgacctccgcctttgatttgacggatcccgatgcgatttttttgttaatggcctgctctatcgctcggcctaagtctttaccactaagcattgcttaatattctcctatgcgcattacattaggcaatccctacccttactgcattaggcacagcctattgacaattgcgttaggcgtcgcctaatatttctgtgtgtttttggagttcattcgatgaaaaaagagaactattcattcaagcaagcttgtgctgttgtcggtgggcaatcagcaatggctaggcttttaggtgtatcacctccaagcgtaaatcaatggatcaaaggggtacgtcaattgcctgccgagagatgtccagcaattgaacgtgcaacaagaggtgaggttctgtgcgaagaacttcgtcctgatattgactggtcatatttacgacgttcggcatgttgttcgcagaatatgtcagtgaagcaactaaatgacagtaacaaatcctcatttgatcatacctgaaacatcaagaggcaaatgattcatgaaaatcaagcatgagcacatcgaatcagtgttgtttgccctagcagccgaaaaagggcaggcatgggtagccaatgcaattactgaagaatatctgcgccaggggggcggcgaattgcccctggttccaggcaaggactggaacaatcagcagaatatctatcaccgttggttgaaaggtgaaacgaaaacgcaaagagaaaaaattcagaagctgatcccagcaattctggcaatccttccgcgcgagctgcgtcaccgactctgcatcttcgataccctggaacgccgtgcattactggcggcgcaggaagcgttaagtacggcaattgatgcgcatgatgatgcagtccaagccgtttaccggaaagcgcatttcagcggcggcggttcttccgacgattctgtcattgttcattaagcaaaagtttccatgctgtttgtgcttattctaagccaccgggcagcatcatacggggcaattatggccgcattaccatacatgcaactgtacatagctgattacctggctgacaccatgcatttgtcagcagaggagcatggtgcgtatttgttgctgatgttcaattactggcaaacaggaaagccaatacctaaaaacaggctggcaaaaattgcccgtctgactaacgagcgatgggctgatgttgaaccatccttgcaggagtttttttgcgataacggcgaggaatgggtgcatcttcggattgaggaagatctggcatcagtcagggaaaaattaaccaaaaaatcagccgcaggaaaagcatctgttcaggccagaagaagcagaaaggaagcagatgttcaaacaaaacaagagagaaatttaacaggtgttcaaacagatgttgaagtggtgtttgaacatgatgtcaacacaaaggcaactaataaagatacagataaagatctaaaaacagatccccccctaaatcccccccgggggaatcgaggtgtcaaaaagtttgaccctctggatattactttgccgaactggatttctgtctcgctttggcgtgagtgggttgaatttcgccaggcattgcgaaaaccgattcgaacggagcagggcgctaacggggcgatacgggagctggaaaaattccgccagcagggtttttcacctgagcaggtgattcgacacagcatcgccaatgaataccagggcttgttcgcgccgaaaggtgttcgacctgagacgttactccgacaggttaacaccgtctcgttaccggatagtgcgatcccgccaggcttcagggggtaactgaccatgaaaaatattgcgacaggcgatgttcttgaacgtatccgcagactggccccgtcacatgtaaccgcgccattcaagacggtagcggagtggcgcgagtggcaactttccgaaggccagaaacgttgtgaggagatcaaccgtcagaatcgtcagttgcgggtggaaaaaattctgaatcgctctggcatccagccattgcaccgcaaatgctcgttttcgaattaccaggtgcagaacgaagggcagcgatacgcgttgagtcaggcgaaatccatcgctgatgaactgatgaccgggtgtacaaattttgcgttcagcggaaaacctggtaccgggaagaaccacttagcggcagctatcgggaatcgcctgctgaaagacggtcagacagtgattgtggttaccgtggctgatgttatgagtgccctgcacgccagctatgacgatgggcagtcaggcgaaaaatttttgcgggaactgtgcgaagtggatctgctggttcttgatgaaattggcattcagcgcgagacgaaaaacgagcaggtggtactgcaccagattgttgatcgccggacagcgtcgatgcgcagcgtggggatgctgacaaacctgaactatgaggccatgaaaacattgctcggcgagcggattatggatcgcatgaccatgaacggcgggcgatgggtgaattttaactgggagagctggcgtccgaatgtcgtccagccaggaattgcgaagtaatttttaccgggagaaaaatttaatggagactgtttttgacgcactgaaagcaatgggaaaagccacatccatagaacttgctgcgcgacttgatatcagtcgtgaagaagtgctgaacgaactatgggaactgaaaaaggctggttttgttgataaaagcgcgtacacctggcgtgtggctgataacaatgttcagcaggaacagccagcgcaggcagaactgccggaagaaatcaccacagcaacagtagcgaaaatctcagagtgcgatttaaccgcgacgattgaacaacgaggaccacaaacggctgatgagctggctacattgtttggtaccacatcacgcaaagtggcttcaacgctggcaatggcaatcagcaaaggtcgtctgattcgcgtaaatcagggcggtaaatttcgttactgcataccgggcgataatttaccagcagagccgaaagcagcatcggtatctccgctctggttatctgcatcgtcgtctgcctgtcatggggtgttaatcattaccgtgataacgccatcgcctacaaagaacagcgcgacaaaaatgccagagaactgaagctggcgaacgcggcaattactgagatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctccgggaacgactggtaatgatgcaggcccaacttgaaggtgctcagcaatacataaccgagcagtgtttaaagtaaaatcttaactacaatatgattcattttgatgattgtttcataaggaacagtgaagtaagatctaagaggagttaaattttatacagtataatcataatattgcagcaaggtggttataattgaaagaatatttagatatgaatacatctcatgtaagagttgttactcatatgtgtgggttcctggtttggctctatagtctttcaatgttgccaccaatggttgtagcattgttttataaagaaaaaagcctgtttgttttctttataactttcgttatatttttttgcattggtggcggagcgtggtatacaactaagaaatctggcattcaattacgtacccgtgatgggtttattataattgtaatgttttggattttgttttctgttattagtgcattccctttatggattgactcagaacttaatttaacgttcattgatgctctgtttgaaggggtttctggaataacaacaacaggagcaactgtaattgatgatgttagttcattacctcgggcatatttgtactatcggtcacagttaaattttataggtggtttaggagttattgttctggcggttgctgtattgccattattgggtattggtggtgcaaagctttatcagtcagaaatgccggggccatttaaggatgacaaactcactccccgcctggccgatacgtcacggacactgtggataacttattctttattaggtattgcttgtattgtctgttatagacttgcaggaatgcctttgtttgatgctatttgtcacgggatttccacagtttcgcttggtggtttctcaactcatagcgagagtatcggatattttaataactatttggttgagctggtggctggttctttttccctgctatcggctttcaacttcactctttggtatattgttattagcaggaaaacgataaaacctttaatcagagatattgaacttcgtttctttctgttaatagccttaggggtgatcattgttacctctttccaggtctggcatataggtatgtatgacttgcatggaagttttattcattcgttttttcttgccagctccatgctcactgataatggtttagctacgcaggattatgcaagttggcccacgcacacgatagtgtttttgctgttgtcaagtttctttgggggatgtataggttcaacttgtggtggaattaagtcacttcgatttcttatacttttcaaacaaagcaaacacgagataaatcagctttctcatcccagagcgttgttgagtgtaaatgtaggagggaagatagttacagatcgtgtaatgaggtctgtatggagtttcttttttctttatactctcttcacggtgttttttatactggtgttaaatggtatgggatatgattttcttacatcatttgcaacagtggctgcatgtattaataatatgggattaggttttggggctactgcatcgtcattcggagtgcttaatgacattgcaaaatgcttaatgtgcatagctatgattcttggtcgccttgaaatttatcctgttattatattgttttcaggttttttttggcgctcctaatatatggctgatttataattgtgagtttaatattatgttgactcactcattgatccaatacctaactttaccagcaacacctccgtccccagtagcactggctgctggggtgcgttttattcataaagcaaggctgtatgagcgagaaattaaagatagtctatcgcccattacaagaattgtcaccgtatgcgcacaacgccaggacgcacagtactgagcaggtggcacaactggtagaaagtattaagcaattcggctggactaatccggtgctgattgacgaaaagggcgaaattattgcgggtcacggtcgtgttatggcggctgaaatgctcaaaatggattctgttccggtcattgttctgtctggcctgacggatgagcagaagcagcgataacgatcagtatcgctcccgtaatgcattaatccgtcgccacattgagaaaatggatgccagtttgcacgtcggaacgaaggagtttgatatttcaaaggtttccgaggtggattctgttgatgatttactcattgataatgccgctcgttatctgctgaaagactggaaaggggttggtgaactggttaatggtgttgaggttgcactggaatatacggcagaacgagggatcgcgctgcttaagcagaatccagagttgtactggcagatccttgcagaagcagccagcatcgcccagggtaaagagcagcagaagcaggatacgataaaaaagccatagctgcccagcggtggttatcggagttcgggggagaaaggggggaaaaggcaagatggaagcgagaaaaactcaggttgccaccgataccggaaccagaaatagacccggtgcttaaggagttgttgtacgcctattcggtaatatcccgtgcccgacgttatgctggaatggctggggtgcctttgcctttatctctgacagagataaatgaatatttagccactcatccggtattgattgagcgcgatgaatttgaagcagtgatctttgcactggatgaccagtattttcaggagcagtgtgtgtagttgttaattacgtacactctgttacagagatgtgatggtgtctttaattaaatcgatgatgctcctggagaaaagcattgcgtggcctcgtaatcgctatatctactattatgtcgcctgaaacccacttcgcggtgggttttttgttgtcaggagttttaataaatggcagagcaaacctcgcgtctcgcaataattattgatagcactggagcgaaaaataatgctgacaatctgacctcctcattagtcaaaatgacgcaggctggggaaactgctgcaaatagcgcagggaaagtgactaaggcaacagaagatgagaagaacgcgctcgcaaaattaaaagcagctattgatccagttggtgccgcaattgatactgtcggtcgacgctattctgaattaaagaaatttttcgataaagggcttattgataaagaagaatatgaatttcttgtccgtaaacttaatgaaaccacagaggaattgagcggggttgcgcaagcgcagagagaagccgagaaggccggaaaacttgctgccgctcagcaggaagcgcaggctcaggcctttcaaagaatgctggacaagatcgaccctctggctgcggcgctaagaaatcttgaacaacagcatgatgaacttaatgctgcgtttgcatccgggaaaataaatggttctcagtttgagaattatagccgaaaaatacaggaaacacggcgagagcttaccggagaggctcaggcagagcgagaagcagcaaaagcgcatgatgaacaggttgttgctttgcaacgtctgattgctcaacttgatcctgtcggaactgcttttaatcgtctggtagaacaacagaaacagctcaatgaagcaaaagctaaggggatgctttctcctgaaatgtatgaggagctttctggaaaacttcgtgctatgcggagtgagcttgaggttactcaatcacaattaagcaaaaccggaatgtcggcaaaacaaacggcttttgctatgcgcatgttgcctgcacaaatgacggatattgttgttgggttgtccactggtcagtcgccatttatggtgttaatgcagcagggcggccattcagctatgcaggagacaagaatcgccagcttacccgttacagcgatacccgctggcatgaagattccgtgcgtaaccgctggttcagcgtgatggtggggccgtctgtgcgcgtgaatgaatggttcagcgcgtatgcgatggcgggtatggcttacagccgtgtgtcgactttctccggggattatctccgcgtaactgacaacaagggaaggtgcgaataagcaggtcatttcttcccaagctgactcgctgattaaaatttcgcggatctgggccgatttttttcccgcaaacacatcgaatcagcctatttaggctattttttccaccatttctggcgttatttccggtttttactgagatctctcccactgacgtatcatttggtccacccgaaacaggttggccagggtgaataacatcgccagttggttatcgtttttcagcagccccttgtatctggctttcacgaagccgaactgccgcttgatgatgcgaaacgggtgctccaccctggcacggatgctggctttcatgtattcgatgttgatggccgttttgttcttgcgcggattctgcttcaaggtttttaccttgccgggacgctcggcgatcagccagtccacatccacctcggccagctcctcgcgctgtggcgctccttggtagccggcatcggctgagacaaattgctcctctccatgaagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtagagctgggtgcctcaatgatggtggcatccaccaaagtgccttgggtcatcatgacgcctgcttcggccagccagcgattgatggtcttgaacaattgacgggccagttgatgctgctcgagcaggtggcggaaattcatgatggtggtgcgatccggcagggcgctatccagggataatcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacagcggtcatattctgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttcccaaggggaaaacgcacgacgtgctgaccggaagtgatgacggtcgccacagcaacacgtctctggcgtggggagctggcgtgcagtttaacccgaccgaatccgtggccattgatattgcttatgaaggccccggcagtggcgactggcgcactgacggtttcatcgtgggtgtcggttataagttctgattagccaggtaacacagtgttatgacagcccgccggttcaggcgggcttttttgtggggtgaatatggcagtaaagatttcaggtgtactgaaagacggcacaggaaaaccggtacagaactgcacaatccagctgaaagcaaaacgtaacagcaccacggtggtggtgaacacgctggcctcagaaaatccggatgaagccgggcgttacagcatggacgttgagtacggtcagtacagcgttattctgttggtggaaggattcccgccgtcacatgccgggaccattaccgtgtatgaagattctcaacccggtacgctgaatgattttctcggtgccatgacggaggatgatgcccgtccggaggcactgcgccgttttgaactgatggtggaagaggtggcgcgtaacgcgtccgcggtggcacagaacacggcagccgcgaagaagtcagccagtgatgccagcacatcagcccgtgaggcggcaacccatgcggctgatgctgcggactcagcacgcgcagccagcacgtcagccggacaggccgcgtcgtcggctcagtcagcgtcttccagcgcaggaacggcatcaacaaaggccactgaagcatcaaaaagtgctgccgctgcagagtcctcaaaaagcgcggcggccaccagtgccggtgcggcgaaaacgtcagaaacgaatgcttcagcgtcactacaatcagcagccacatctgcatccaccgcgaccacgaaggcatcagaagctgcgacctcggcccgggatgcggcggcctcaaaagaagcggcaaaatcatcagaaacgaacgcatcatcaagcgccagtagtgcagcttcctcggcaacggcggcaggaaattccgcgaaggcggcaaaaacgtccgagacgaacgccaggtcttctgaaacggcagcgggacagagcgcctcggctgcggcaggctcaaaaacagcggctgcgtcgtctgccagtgcagcgtcaacaagtgccgggcaggcctcagccagtgccaccgccgccggaaaatcggcagaaagcgccgcatcgtctgcttcaacagccacaacgaaggctggcgaagccactgaacaggccagcgcagcagcgaggtctgcttccgcagcgaagacatccgaaacgaacgcgaaagcgtcggaaacaagcgcagaatcctcaaaaacggctgccgcatcgtcagccagttcggcggcgtcatcggcatcatcggcgtctgcttcaaaagatgaggcgaccagacaagcgtcagcagcgaagagcagcgccacgacggcatccacgaaggcgacagaggctgctggcagtgcgacggcggcagctcagagcaaaagtacggcggaatccgcggcaacgcgcgccgagacagcagctaaacgggcagaggatattgcatccgccgtggcgcttgaggatgcaagtacgacgaaaaaggggatagtacagctcagcagtgcgaccaacagtacgtctgaaacgctggcggcaacgccaaaggcagtaaaatcagcctatgacaatgcagagaaacgtctgcagaaagaccagaacggcgctgatatacccgataagggatgcttcctgaacaacattaacgcggtcagtaaaacagactttgctgataagcgtggtatgcgttatgtgcgggttaacgctcctgcaggtgcaacatctggaaaatattaccctgttgttgttatgcgttctgctggctcagtaagcgaactggcatcaagagtcattatcaccacggcaacgcgaaccgcaggcgatccgatgaataactgcgagtttaacggatttgttatgcctggtggctggactgacagggggcgttatgcttatggcatgttctggcaatatcaaaacaatgaacgagccattcactcaataatgatgagtaataagggcgatgatttgcgctctgtgttctatgttgatggcgctgctttccctgtttttgcgtttattgaagatggcctgtcaatatccgcacctggtgctgatctcgttgttaatgatacgacctataagtttggggcaacaaatccggcgactgaatgtatcgcggcggacgttatccttgattttaagagtgggcgtggtttttatgagtctcattcgttaatcgttaacgataacttgtcgtgcaaaaaactttttgccacagacgaaattgtagcgcgtggtggtaatcagattcgaatgataggtggggagtatggtgcattatggcgtaatgatggcgctaaaacttacctgctgcttaccaatcaaggtgatgtttatggtggctggaatacattaagaccgtttgctattgataacgcaaccggcgaactggttattggaaccaaactgtccgcaagtctgaacggtaatgcattaacagcaacaaagctgcaaacgccaagacgggtttctggtgttgagtttgatggttccaaagatattactttaaccgccgcgcatgtggctgcttttgccagaagggcaacggatacatatgccgatgcggatggtggcgttccatggaatgccgaatctggcgcttacaatgtcacccgctctggcgacagctatattctggttaacttctataccggagtcggaagttgccggaccctgcagatgaaggcgcattacagaaatggtggtctgttctaccgttcttcaagagacggttatggttttgaggaagactgggcagaagtttatacctcgaaaaatcttccaccagaaagctacccagtcggcgcaccaatcccgtggccatcagataccgttccgtctggttatgccctgatgcaggggcaggcttttgacaaatctgcttacccgaaacttgcagccgcttatccgtcaggcgtgatccctgatatgcgtggctggacgattaagggcaaacctgccagtggtcgggccgtattgtctcaggaacaggacggcattaaatcgcatacccacagcgccagcgcatccagtacagatttggggacgaaaaccacatcgtcgtttgattacggcactaaatccacgaataacaccggggcacatacacacagtgtgagcggctctacaaactcggctggagcacacacacactcactagccaacgtgaacacggctagtgctaactccggtgctggtagtgcatcaacaagattgtctgttgtgcataatcaaaactatgcaacatcatctgctggcgcacatacccactcactgtccggcactgctgcaagcgcaggtgcacacgcgcatactgtcggtattggtgctcatacgcactccgttgcgattggttcacatggacacaccatcaccgttaacgctgctggtaacgcggaaaacaccgtcaaaaacatcgcatttaactatattgtgaggcttgcataatggcattcagaatgagtgaacaaccacggaccataaaaatttataatctgctggccggaactaatgaatttattggtgaaggtgatgcatatattccgcctcatacaggtctgccagcaaacagtaccgatattgcaccgccagatattccggctggcttcgtggctgttttcaacagtgatgagtcatcgtggcatctcgttgaagatcatcggggtaaaacggtttatgacgtggcttccggcaacgcgttatttatttctgaactcggtccgttaccggaaaatgttacctggttatcgccggaaggggagtttcagaagtggaacggcacagcctgggtgaaggatacggaagcagaaaaactgttccggatccgggaggcggaagaaacaaaaaacaacctgatgcaggtagccagtgagcatattgcgccgcttcaggatgctgcagatctggaaattgcaacggaggaagaaatctcgttgctggaagcatggaaaaagtatcgggtattgctgaaccgtgttgatacgtcaactgcacaggatattgaatggccagcactgccgtagggtaaaacatataaattctataattagatgtatctttccatttacggcaaggaagggggcttggaagacgtaaagcatctcacaccgagattattttttatatgtcaggtgtctgaagttttgctttggctcttaaaatggtttgccgcgaggttttgaattcccgggcaatggcacttatacttacacctgacttaattcgttcgaataccacctgtttctgttcttcatttaacacaggaggtcgaccaaaacgtttccctgcgccgcgggctcttactatcccggaatgagtgcgttcaagtaaaaggtctcgttcaaattcagcgactgctgaaattacttgcatcatcatttttcctgttggactggtcaggtcaatgccacccaatgctaagcaatgcactctgatacctgtttcggtcagttgttccactgttttcctgatatccattgcattacaaccaaggcgatccagttttgtcacaatcaattgatcaccacatttcaggcgagcaagcaaccggttaaaaccaggacgctcactggttgctgctgagccgctaatgtgttcttcgattatttgctgaggtttgattttaaaacctgcactttcgatttcccggcgttgattttcggtggtctgatccagcgttgatatccgacagtaagcaaaaattcgagacatagtgagactctatacgaaattggtgttcatatcataatgcatctcagaaaataattatgattatttttgtgcatatttgtatgtacacgttcgaaaataaacgaatgcgtatgcaaccccgtaattttggtgagacccaaaatcgattttgtgaaaaatggctttaactcggtttgtttttcgagttccgggcggactcaaggaagaagaatagtgttgcgtgttattttaaccagatttcaagttgtttggtcgtggaaaagtggagcaaaatgttgttaaagtggaaaaatgataaaaaagtaagtttattatattacattttaccatttaaattttggttgtctttaagaactgatatcgctgtttgtaataattctttgttatccagccatgatgttttctttatgtttccttcaatgtaatcaagcaatgttctggtattgataggtcttccctgttttgctacttccactacagcatcccctaggataattcttacttcaggaagctgcgcagggaaccactttagggtgtcttttgatttcatgaagatattccttaaaatattattgattttcattgcgatattgtatgtctgattcaggatatgttgacttatacatcggttttgtctgggttattggatatgccaatccctaattttattagagcatgactaaaaatgctgaatatgataaggagcgaagtgattatcagtatgctgttcatatagcctcgaattagtaatgtgttatatatgatatagttgacaatttttatcctgggtgttcttaaagttcgtagataaacattgtcgtttcaggtatacaggaatgctaacaggtggcggcaaaaatcaggcggtttatggcgcaagctgaagtggcaactgcaaactatcttatgcagagactctacacggattgggtttaaaagtatacatagataacagtttttatctgaagaagaaaaatatcaaggtgatatagcctatatgcctttgatgcggaggaatgaatgtgatgggagtgatgtatctgaatagttgaaaaaccgcagtcacgtcgtatgcaagaacgtgctgcggttggtttgactttgattgagacgttttggaatttttttcggtggcaaaaatggggcaaaacgctgcaaaaggggcaaaaaaggggcaaaaaaagagtggattatcgtagcttattgttgtcgctgatgatatttaacacattgaaaaataagtaaaatacttatgagtcagagagttgtgatttttgcccttacttgttcaggttgtattgttctttcttactaatttcttgattttgcgacatttaaaagcgactcaattcgttatatggcatcagaagagtatgcgtcatgccggaacgcccagcataagaaatctgatataaaaaactgtggcgtgtatggtacggattagaggggaaaatgtcagcacatttgcgaaatgaatcaaaaagcccgcagcaatgtgcgggcgttagtgtcagcgcacaaccagcacggagcactctgcgtgacgcactacagctgcggcgttggaaccgagcagataagtggtgatatccggtcgatgggaagcaatgatgatcatatgagcggggatcttcttcgccaattccagaatgcggtctttgggcgagccttcctcaacatggacatgcactctgtcggttggcagtttaaattttttaatgatctcttccagttgcgatttggcttccgctttcaggtcatccattgccggtaattctgcggaatacgctaaacccagagaggcatagtagggcagtgaaggtattaccgtcaggaaatgaacctctgcatcatcaatctttgcctcttcctcaacgtggctaatcacgcgttgagttaattctgaatcggaaatatcgatagggacaagaatcgttctgttcataaaacctcctgttttagtatccgcataaagtgtaacgccagatgacactttttgtgtaatgacggagttcacatttttaatttagatcaaaggaggaagaataagcagaaaaagcccgccataacagcgggcaggaggatttagaactgataaaccagacctaaagcgacaatatcatcggtagagatgccattggcagcgtagaagctgtcatcttcatccaacaggttgattttatagtcaacgtaggtggacatgtttttattgaaatagtaagtcgcgccaatatcggcgtatttaaccagatctttatcatcaacacctgccgggttgtctgcaccacccgcagcgtgcaggtcacggcctttagacatcaggaaagagactgccggacgcagaccaaaatcaaactggtactgtgcagtgacttcaaaattctgggttttgtttgccacagcataatcgctgtcgccaaacggggtcatattacgcgtttctgaatacatggttgccaggtaaatattgttagcatcgtattttagcccagcagtccacgcgtctgctttatcaccacccgccgcagtatggttaacctggtcattggtgcggtcagaagaggtgtatgccgcaccagcgctaaagcccatgcctaaatcatatgttgtggaaagaccccagccgtcaccgttttcatggcgaacatcacgtccgttgttggtgccttcctgaccattactggctccttcgttgttaccttgatactgcaccgcgaagttcagaccatttaccagaccgaagaaatcagtattacgataagtcgcgacgccattggctcgaccagtcataaagttgtctgcattggtataagagtcaccgccaaattcaggcagcatatcggtccagccttcgatgtcgtacattacgccataattacgtccgtaatcgaaagaaccgtaatctgcaaatttcagcccggcaaatgccagacgggtccatgactggttttttgaagattcagtgttgtttgcctgaatattgtattcccattgaccgtagccagtgagttgatcgttaatttgggtttcgcctttaaaacccagacgcgcatagctctggtcgccatctttcgctgaattatcagaaaaataatgcaggccatcaactttgccatacagatctaatttgttgccgtctttattataaacttcggctgcatgtgcagcacctgcggcgagcagggcaggaattaaaagtgccagtactttgcttttcattgaataaatcctttagttattttatttgccttttatccccatttcggggagtgaaaacatcctaaaggagaagttcagttagccgataaatatcatttgttacgccttaagtaaaaccttaatcaaataattcctctgaaatgataataagtctggtgaatgtatcgaagataatacatacaaaataaaaattatacttttaatttgctatacgttattctgcgcgggttatatgcctttattgtcacagattttattttctgttgggccattgcattgccactgattttccaacatataaaaagacaagcccgaacagtcgtccgggctttttttttagaattggataatccttatccagagcatttaatcggtgttgcttttttccgcttttccggccatttgtgccaggaagtcatagcgtttttgcaaatcagctgcagcatctttccataactgttctgccacttctggctgctgcgaattcagccgacggaaacgttgctcgtgaagtaacgtttcttccggtgcttctgacggcgggcgtgaatccaaggccagcggcagtttgccttcatcggcacgacgcggatcaaagcgatatagcggccagaagccggtagctgtgagttggcgcatctggtcgtggctgagtgccagatcgtaaccatgctcttcacacgggctataagcaatgatcagcgatggccccggatacgcttccgcttcctgaatcgctttcaccgtctggttcagctgcgcgccgagagaaatctgcgccacataaacatgaccgtacatcatcatactgacgccaagatctttacgcgctttacgtttgccgtgctcgccaaatttagttactgcacccagcggtgtcgctttcgacgcctgaccaccggtgttggaatagcattgcgtatccagcaccagaatgttgacgttttccgtcaaactcaatacatgatccagaccgccaaagccgatatcgtaagcccagccatcaccaccaatcagccagattgatttttccaccagtgcatctgcatcacgtagcagttcatgtgcttcggcaacatcgttgagttgctggcgtaaagctgcaacctgttcacgacgaacctctggcgtggcgtctgatttcaacgccgtcagtaattccgccgggattttatcggcaaattgatccagcagacgcagcacgcggacacggtgttgatcgaccgtcaggcggaaaccaaggccaaattcggcattatcttcaaatagagagttcgcccatgccggcccacgaccgttggcatcggtggtatacggtgtagagggcaggttaccgccataaattgaagaacagccagtggcgttagcgatcaacatccggtcgccatagagctgagtcagtaatttaatatacggcgtctcgccacaaccggagcaagcacctgaatattcaaacagcggtgtaatcagctgcgatgtacgaatatcaatacgttccagtttgctacggtcgatttctggcaggttgaggaagaaatcgtaattgattttctcttcttcgacatgttccaggcgagacatcatattgatggctttaatctctggattctgacggtctttcgccgggcaaacttcgacgcacaggttacaaccggtgcaatcttccggtgccacctgcaagacatatttctgcccgcgcatatcacgcgatttcacatccagcgaatgcaggctggcaggggcgttttccatcgcttcaggcggcaccacttttgcgcgaatagctgagtgtgggcaagcggcaacgcagtggttacattgggtacagagttcctctttccagatggggatctcttcggcgatattgcgtttttcccagcgcgtagtgcccatcggccaggtgccgtctggcggcagcgccgaaacggggagggcgtcaccaagcccggcgagcatcgcagcggttacggttttcacgaaatcaggggcggcatcggaaaccactggcggtcgattggcgctgtgcggatttaccggttgcaacggaacttcttctacggattcacgcgccagcgccagagcctgccagttgcgttccaccagatcctggcctttgctactgtaacttttggcaatcgcaccctgcaattctgcgagggcgctatcgccaggcagaatttgcgtcagatggaaaaaagccatctgcatgacggtattaatacgggccgccaggccacattcgcgggcgattttcgccgcgttaatcacatagaagcgcgcttttttctggtttaacacggcctgaacttcttgcggcaagcgcgaccacacttcatctgcgctgtacggcgtgttgagcaggaaaatgccgccaggttttaaacgctcagccatctgatatttatcgataaactgcaactggtggcagccaacaaaatcagcctgggaaatgagataagcggaacgaatcggctgttcgctcactcgaaggtgagaaaccgtcaggccgcccgcctttttggagtcgtaaacaaaatagccctgtgcgtaccacggcgtggaattaccgataatcttgatattgtttttggtcgcggaaacgctgccatcactaccaaggccataaaacaaggcttccagtttcgccgagtttggcagggtgttttccggcaacggcagtgacagattggtcacatcatcgtaaataccaaccgtaaagcgcgctttcggtttagccgcgttgagctcggcaaataccgccagtacacagtctgggccaaattctttggatgaaagaccatagcgcccaccaatgacacggggcagagtttcgcgctcgccattattaaaggcttctgccagtgcggtcattacatccagatagagcggttctgcctgggcaccgggttctttggttctgtccagtaccgccacgctgcgtacggatcccggcagagcttgcagtaaatgtttagcggagaaggggcggtacaggcgaactttcagcacgccaactttttcgccacgggttagcaattcatcaaccacttcttcacaggtgccaatggcagagcccatcaggataatcacccgttccgcttgcggatgcccgtaatattcaaacggctgatactgacgacctgtcgcggcagagaaatcattcatcgcctgttcaacatggtcatagaccgcgttgtaccatgggttggtggcttcgcgagactggaaataagtgtcaggattggcggacgtaccgcggatcaccggatgttccgggttgagtgcccgggcgcgatgagcatcaatttcgacctgcggcatgagatcaagaatcgtgtcatcggccagcgggacaattttattgatttcgtgggacgtgcggaaaccatcaaagaaatgaataaatggcacgcggcttttcagcgtcgcgatttgcgaaatgagagcaaagtcttgcgcttcctggacgtttgctgcacacaacatcgcgcaacccgtctggcgcaccgccataacgtcggaatgatcgccaaaaatagagagtgcatgtgtggcaacggtacgtgccgctacatgcaggacaaacggtgttagttcgcctgccagtttgtacagcgtcgggatcatcagcagcaaaccctgcgatgacgtaaacgatgttgaaagggcacccgtctgcaaagcgccatgcacggtagcgatagcacccgcttccgactgcatttcaaccacgcgtggtgtgtctccccaaacgttctttaagccgtttccggcccaggcatcagcctgttctgccatcgtggaactgggggtaatagggtagatggcgataacttcactggtgcgaaatgcgaccgaagcaaccgcgccattaccgtcaatagtaatcatatgacacccttacattgcgcaaatgaggggcgcacgaaattgctgcgcgcccagtagtaatctttcaattttagcaaatggctttcttctgcattttcgcttttgtgtcccccacatcagcgtaatgaatgttttgatcaaacagagggcaaaaaaatagccataaaaaagtaaaaatgcggggcaacgcgcaggacagctctcgacgccgccctctgtgctgcctattatttatggcggtgtcgtttggcttgaagatcagaggaagaaaagatgcgagcagcgttttgggtagggtgtgccgctttattgttgtcggcgtgtagtagtgaacctgttcagcaggcgactgccgcgcacgtagcgccaggtttaaaagcgtcgatgtccagtagtggagaagcaaattgtgcaatgatcggcggttcgctttctgttgcccgtcaactggatggtacggcgattgggatgtgtgcattacccaacggcaaacgctgtagcgaacagtcacttgccgccgggagctgtggcagctattaattcattaaatccgccagcttataagttaatgtctgttttgcggtcgccagcgttaactggttcgcggtcagatccacttgtgcaccttctttcagcatttcgctaatggtgttatcgagttcattaagctgcgggttagcgcacatcatacgggtcattgccagccctttggctgtcagttcaccattagacagtttgccttcaccgctaaagcggttacacatgctgccggaaatcatcattttttcaccaaagctgatttctggcggatttttatcgctggtcacgggcttaccgtttacgctttccagcacaaagcgatgatgctgtagctgttctggcgtaacagcaattttgtcattacttacacatcccgccatcagcaggcttagcgcaacaaacgcggctactttcttcattgtggttctcaattacagtttctgactcaggactattttaagaatagaggatgaaaggtcattggggattatctgaatcagctcccctggaatgcaggggagcggcaagattaaaccagttcgttcgggcaggtttcgcctttttccagattgcttaagttttgcagcgtagtctgagaaatactggtcagagcttctgctgtcaggaatgcctggtgcccggtaaacagcacgttgtggcaggcagacaggcgacggaatacgtcatcctggatcacgtcgttggatttatcttcaaagaatagatcgcgttcgttctcatacacgtccatacccaacgaaccaattttctgatttttcagcgcttcaattgctgcctgagaatcaatcaatgcaccgcgactggtattgacgatcatcacgccatttttcatctgttcgaaggcggcttcgttcaacagatgatagttttccggtgtcagcgggcagtgcagagagataacgtctgattcagagaacagggttggcagatcgacatactccacaccgagttccagcgccgctgcacttggatacggatcgaacgccagcagacgcataccaaaacctttcagaatgcgcagcatcgccacaccgattttaccggtaccgataacgcctgccgttttgccatacatagtaaagccggtcagaccttccagagagaagttagcatcacgggtacgctgatacgcgcggtgaatacggcggttcagcgtcatcatcataccgatggcgtgttcagcaacggcctctggatcataggctggaacacggactactttcagccccagttcttttgccgcgtcaaggtcgacgttattgaaaccggcacagcgcagggcgatatatttaacgccgtgctttttcagctcttccagcaccgggcggctgccgtcatcgtttacgaaaatacataccgcttcgcagccattggcagttttagcggttttttccgtcagcagaaagtcaaaaaattccagctcaaagccaaaggactcgttcacctgttgcaggtacttcttgtcgtactgttttgtgctataaacggcgagtttcataagactttctccagtgatgttgaatcacatttaagctactaaaaatattttacaaaatttcaaatttaattgaaagctatggcgatattgaaaaattcatcaacaactatgcttagtgtaggcgcaaccttcaactgaacggttaaacatgccacaatacccgtattgaatgcttaatttttcgctaaatcaggatattaactacccatgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcattcccgatctccgttatctggtgggagattgtcagcttgcgcatatcaccaacgccagcctttcacatcccagccgctggttattgaacgtcggcacggtagaacttgattctgcttgtctggcgaaattgccgcagacggagcaatcgccagccgctccaaaaacactcgcgcagtggcaggccatgctgcctaacacctggatcaatatcgataaactgattttttctccctggcaggaatggcagggaaaactctctctcgcattaacctctgatatccagcaactgcgttatcagggcgaaaaagttaaatttcaaggccagctgaaagggcaacaacttacagtcagcgaactggatgtcgtcgcgtttgaaaatcagccgccggtaaaactggtgggggaatttgctatgccgctcgtgccggatggacttcctgtaagtgggcatgctactgcgacgttaaacttgccgcaggaaccgtcactggtggatgccgagctggactggcaggaaaatagcgggcaattgatcgtgctggcacgggataacggcgatccgttgctcgatttgccgtggcaaattactcgtcaacaattgaccgtaagcgatggtcgctggagctggccgtatgcaggttttcctttgagtggccgactgggtgtcaaagtcgacaactggcaggcagggcttgagaacgctctggtcagcggacgactgagtgtgctgacccaggggcaagcgggtaagggcaacgcggtgcttaattttggcccaggaaaattaagcatggataacagtcagctgcctctgcagctgaccggtgaagcgaaacaggcggacctcattttatatgcccgtttacctgcgcagctaagtggaagtctgtctgacccaacgctgacctttgagccaggcgcgttacttcgttcaaagggaagagtcatcgattcgctggacatcgatgaaatccgctggcctttagcgggtgtaaaagtcacccaacgtggtgttgacggacgtttgcaggccatcttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccatcgtctgggtacgtgacgcacagcatccctcctttagcggcgcgctgtcactggacgccgggcaaacgctgttcactggcggcagtgtgttaccgccatcaaccttaaaatttagcgtcgatgggcgcgatcctacctatttcctctttaaaggcgatttacatgctggtgagattggcccggttcgggtaaatggtcgctgggacggtattcgtctgcgcggtaacgcctggtggcctaaacaatcactgaccgtattccagccgctggtgccacccgactggaagatgaacttacgcgatggtgaactgtatgctcaggttgcattttctgctgcgcctgaacaaggattccgcgcgggaggacacggcgtgttgaaaggcggtagtgcctggatgccagataatcaggttaacggtgtcgattttgtcctgcctttccgttttgccgatggagcctggcatctggggactcgcggccccgttacgttgcgaattgccgaagtgattaatctggtgacagcgaaaaatattacggctgatttgcaagggcgttatccgtggactgaagaagaacccttgctgttgactgatgttagcgtcgatgtgttaggcggtaacgtactgatgaaacaattacgtatgccgcaacatgacccggcgctgttgcggctgaataatctctcatccagcgaactggttagcgccgtcaatccgaaacaattcgccatgtccggggcatttagtggtgcactgccgttatggctgaacaatgaaaaatggattgtgaaagatggctggctggcgaatagcgggccgatgacattgcgactggataaagacactgcggatgcggtggtaaaagacaatatgactgcgggttcagcaattaactggttgcgctatatggaaattagccgttcatcgacaaaaattaatttagataatctcggtttattaaccatgcaggccaacattacaggtaccagtcgcgttgatggtaaaagcggtacggtaaaccttaattaccatcatgaagagaatatttttacgctgtggcgcagtttacgctttggcgataatctccaggcatggctggagcagaacgcacgtctgccgggaaatgactgtccgcaaggaaaagagtgtgaggaaaaacaatgaaaattttactggctgcgttgacgtcatcttttatgctggttggctgtacgcctcgcattgaagtcgctgcacctaaggaaccgatcactatcaatatgaacgttaaaattgagcatgagatcatcatcaaggcagacaaagatgtcgaagagctgcttgaaactcgtagcgatcttttctgaggtgatgatgaagaaaacattacttctttgtgcgtttcttgttgggctggtaagcagcaatgtaatggcattgactctggatgaagccagaactcaggggcgggtaggtgaaacattttacggttatctggttgcgctgaaaacggatgctgaaacagagaaattagtagccgacattaatgccgaacgtaaagcgagttaccaacaactggcaaagcaaaataatgtgtcggtagatgatatcgcgaaactcgccgggcaaaagctcgtagctcgggccaaaccgggggaatatgtacaagggataaacggtaaatgggtgcgaaaattttaatagcaaaaccgcaatatcgggataacgctacaggagaaggcgattgatctattttcctgaaacaaggtgaatattcaaaaactcctgtcaaattgccttttgccctgaaaaatgcatagtcaaatatctgttttaactaattggcgttgcagtacatgcaacgccaattagttagcggaatttacgtcgatactcgcctggcgtcatcccaaagcgttgcttaaataccgttgaaaaatgactctggtcagaaaatccccaatgaaagccgatgcctgccagtttttcatcatctgcggcatggcgaatcgcatctgcacaaaaatcgagacgacggttacgaatatattgcgcgactaccaaacctttatcggcaaacattcggtacaaactacgtactgacatacctgtctctccggctatccactccgggcgtaatatctcttcgcgaatattatcgtctatcaacgtaaccactttttgaaactgacgttcacgacgaggttgaacagattcccgctgatgaagtaccgggcgcagcagacacaccatcgcctgtagcgcagcttcactttctgtttcagaaagtgccggattattcatgctctcctgtaacaggcgatgactgagttgcaccatgggtaagtcagcgtccagtctttctgcgcagataggtttttgatggggaaaatattgttccagcagagtgcgtggcaaaagtaatgaaatctgtttagaagactcctgccagtaaagcgaacaggggcgtgaggcatcgagtaacgtaatatcgccagcgccaatctgcacctgacgctcatcctgctccattattgcctgaccactaagctgaaaaacggtgtaaaaccaggcatcgtcgctgccttttacttcctgccaggtgcgggataaattcaccccgctggttgtcacggtactcagctttagtcctttggcaaaatgcgtgtccagtacacccgtgtaacgctcagtcagcaggcgtccggtaaaatttccgcatacctgattgatttgggaaagccattgctgaaactcattatccactgcggggttcatggcacgttttcgctctgtgaaatgtatttttattgttgcatttgtgttgcaataaacgaagctaatgagcctgactataggaaataagtcttgtcaggcatagagacataagcggttattgtcacgatttgcggagcttgtcacagctgacaaagcgaatgtcacagcgaaaaaagtgacttttcttgtcgctgcgtacactgaaatcacactgggtaaataataaggaaaagtgatgacagagccgcatgtagcagtattaagccaggtccaacagtttctcgatcgtcaacacggtctttatattgatggtcgtcctggccccgcacaaagtgaaaaacggttggcgatctttgatccggccaccgggcaagaaattgcgtctactgctgatgccaacgaagcggatgtagataacgcagtcatgtctgcctggcgggcctttgtctcgcgtcgctgggccgggcgattacccgcagagcgtgaacgtattctgctacgttttgctgatctggtggagcagcacagtgaggagctggcgcaactggaaaccctggagcaaggcaagtcaattgccatttcccgtgcttttgaagtgggctgtacgctgaactggatgcgttataccgccgggttaacgaccaaaatcgcgggtaaaacgctggacttgtcgattcccttaccccagggggcgcgttatcaggcctggacgcgtaaagagccggttggcgtagtggcgggaattgtgccatggaactttccgttgatgattggtatgtggaaggtgatgccagcactggcagcaggctgttcaatcgtgattaagccttcggaaaccacgccactgacgatgttgcgcgtggcggaactggccagcgaggctggtatccctgatggcgtttttaatgtcgtcaccgggtcaggtgctgtatgcggcgcggccctgacgtcacatcctcatgttgcgaaaatcagttttaccggttcaaccgcgacgggaaaaggtattgccagaactgctgctgatcacttaacgcgtgtaacgctggaactgggcggtaaaaacccggcaattgtattaaaagatgctgatccgcaatgggttattgaaggcttgatgaccggaagcttcctgaatcaagggcaagtatgcgccgccagttcgcgaatttatattgaagcgccgttgtttgacacgctggttagtggatttgagcaggcggtaaaatcgttgcaagtgggaccggggatgtcacctgttgcacagattaaccctttggtttctcgtgcgcactgcgacaaagtgtgttcattcctcgacgatgcgcaggcacagcaagcagagctgattcgcgggtcgaatggaccagccggagaggggtattatgttgcgccaacgctggtggtaaatcccgatgctaaattgcgcttaactcgtgaagaggtgtttggtccggtggtaaacctggtgcgagtagcggatggagaagaggcgttacaactggcaaacgacacggaatatggcttaactgccagtgtctggacgcaaaatctctcccaggctctggaatatagcgatcgcttacaggcagggacggtgtgggtaaacagccataccttaattgacgctaacttaccgtttggtgggatgaagcagtcaggaacgggccgtgattttggccccgactggctggacggttggtgtgaaactaagtcggtgtgtgtacggtattaatctggttcgctcataagtaaaaaacggcacctggtgccgtttttttgtctgaaacaatcacttatctttcttcagcgcccctagcgttggcgtttcgtcaaagaagttccatggtttcagcagagtatgtacccattcggtcggcataatcggccactcttcggcgcgggccacatgtgtggtgccggtggtcatccagacaacggcgtcggtgttgtccagcgactcgttatccttactgtattgtccaagaccggtgtcatgagtagaacggttcggatatttgccttccgggaaacgctcgccaggatgataacgcgttacccagagctgcttgtccataaagcttaaacgatgatagatccactcgtccggcgcgaactgggcaccttttgctaccgggtgagtaccacctgcataaggaataatttgataggaaaccggattgcccatgcggttctctttgttcgggttactcaacagacgaatcgtgcccggatcaaatttctgtgcggcatcctgttcattgccgatgttgtactgattaacttgcatggtactggtgcgtgggccaccggcagtattcggttttaccactgggtccatcgccaccaggctgttattctcgccatctacatccagatcgaggcggaaattataaatatgttggtgtgtagtacccacgatattgtgatcgataagcgtgccgtagcgcgtgtcatctttcgccgtctcatcgtgcatggttttcgctttaacacctttcaccgcttcgatgcccgtagcaccggcatcgatgccaatagtgccgttttcatggaagatccagtcaaaaatgtagtcatagttacccactgtactgatccagcgcaccactaactcccggcgttcggtactgacgttgggctggcccatttcctgatgcttatactccggcccggcataacgttcaaataccgcgatagcgcgagggatctccatcggcacgccagtgtagtcggcgatggtttcattaaggagcactgcgttagacggggcatctttaccacgagcaattggtgaggttagcgtgcccataccgtagtcaccagagtccagatacgctttaaagtaccagccaatatcaggatcaccgtaaggcacaatcatgccgccgagagaaccttcgtacatgactttgcgtttggtgccattgtcgttataagtcacggtggagatcatcggcccgacgcgagagttcatgctgaggtgaaaatcccagttccgccagtgaatcatatcgccagtaatggtgtaatttttaccttcaggctcaatgatttgcataggcttaactgccggagcaacgcggtcacggccatcaaatgggcgtgcggtcattggcaccggaactaccggaccttcttcaatcttaacgatttttttctgttctaaatcaacgaccgccaccaggttttcgatgggatgtgcccagtagttgccatcaccgacatcaagatagctgatgactttgagcaaccgggcatcttgtttcaggccatctttaccatcgaaataacctacggtcagcggcgtggtaatcacttttttcgcatcagtaataccgcgtttcttcacggcagcggcaaattcttcactgttgttaataatgttctgcacactggcgaaatcatccagcaacaccataccgtgggcgtctttaatgggttgccaggagagcagtttgttgttttgcagatccaccaccgcttcgatgatatgtttgccgtcgagcataatgacgtcggctttgcgcggctggtcaaccggtttgttttccagcgcaaacgcccagacagcttctttatctggcggtagcagggagatctcagtaaaacgggtattgggtttgaagtccgcggaagctttaacaatttcaacggcctgtttaatttcgtccgcagttagcgcattaagtgggtgagggcgcttttctacctgaaaggtttgatccagcccggactggaaaacatcgttaataaaggtgtcagaaacccaggctttattgtctttcatcactaccggtacttgcagtgccagaggctgaccattaacaattgctgtttgcgcaccaggcttcactttcacgtacgcgccatctttaatcagggtaaagagctgggcgtagtcgtcccactgcacatcggcaccaaattctttaagcgttttatccattggcaccatatgcgcttcaccaccgtgggcaaataccggcgcttgccaggcgaaacttaaggcgactgccaacgccagggttgttttacgggcagaatacagagaggggcttcccattattaacctcgtcagatgttgtgttcttgttagcaaccgcgctctgtgggcggtttagtcaggttcacattatcagtactgatgcaaaggggattgcctgcacctgccaggttgtttggcaggtgtgccagcttttcatacagtggatgccctgaaaatagatgtacacatcatgcataatgtgacaacgtcacaaaacttagtgaaataaaagggcaactattcgccgttgcccttcattcaccgattaatcgacaaaatcaccgtgctgcctggccaccagcgtcagaattgaatacagcgccaccggggtttgatgctgattgaatacctctacagcccattccaccacacctgttggtttttcttctgcgctacgctgttttttcagcgtcttgcgcttacaggtgagacgcacctggatggtatcgcctggctttacgggttcgataaaacgcaagctttccagcccgtagttagcaatgaccggaccgacaccggcatcgacaaacagacccgcagccgcagaaagcacaaaatacccatgcaccacccgctcaccgaaaatagattcggcagcagcaatcttatccatatgtgcatagaaatgatcgccgctgaggcaagcaaagttaacaatatcggcctctgtcattgtgcggcggggagtcaacaggctgtcgcctggttgtagctcctcaaaatatttgcggaacggatgaatacgatcttcttcgactttcgcaccgcgcacccactgtttactgatagcggcaagcatcgtcggactaccctgaacagcggttcgctgcatgtaatgtttcaccgctcgtaaaccgcctaattcttcaccgcctcctgcgcgaccaggcccaccatgtaccagttgtggcagtggggagccatgcccggtggattcttttgccgactcttcattgaggatctgaattcgcccatgcgtacgtgccgcgtcggcaataaactgacgcgcaatttgcggatcagccgtcaccagcgttcccgcaaggctaccgccgcctgcacaagccagttgcagagcatgtcgctggttttgtgctggcatcagcgttgcgacagggccaaaggcttctgttgcatgtaccgccggtgtttcatccggctgcggacagtacaataaggttggcgggaagaaggcacccgcagcagataaatccgcctgaccaccgaggcgaatctcgcatcctgcagccagcaatatgttcactttttcctgcacatcggcacgctgctcagcatttaccagtgcgcccattttcacgccttcctgagcaggatcaccgaccacgactttctgtaatcgcgcaaccagagcatcactgacagcattaaccaatgcctgcggcacaataatccgccggattgccgtacatttttgcccggcttttgtggtcatctcacgcacaacttcacgaataaacagcgcaaactccggttgatccggggtgacatcttcgcccagtacgcagcagttcagggaatcagcttccatagtgaaggggatagatttggcgacgatatttggctgaactcgcagcatctgtccggtcgccgctgaccccgtgaaagtcaccacatcctggctgtccagatgatccaacaagtcgccagcactaccgcagatcagactaattgcgccttcgggaacaagaccactatcgacaattgatttcaccatcgcctgagtcagttgggccgtcgcggtagctggtttgatgatggctggcattccgcccagccacgttggtgccagcttttccagcattccccagcaggggaagttaaaggcgttaatatgcactgccacgcctgactttgaggtcagtaaatggcgcgcggcaaatccaccttctttcgataaggggatcaattcatcttccggccacagcgtatcgtcaggcagctcccggctaccgaggctggcgtaagtaaataacgtcccaatgccaccttcaatatcaacccaactgtctgcccgcgttgcgcctgtttgcgcagaaagagcatagaaacgctctttttcactcagcagatgtttagcgaccgctttaagcatcgccgcacgttcgataaaggtcatagcgcgaagggcgggggcacctttttcaatggcaaactggcgggcagccgccatatcaagaccttcactggtcacttcccataacgcctcgccgctaatagcgtggtgaatcaaacggctacggccccggccagactgccaggtaccggataagaaactggctaactgctgcatcgctactctccagatgtttcacatttctgttgctaatagttaaatcgcgaatcataaaaagcaaaggatcttttaacgaaatgttaactatgcgatctgtatagcaactgcggaaaacattaatgcactgataaataatgatttataaaaatagggtgcgaaatccgtcacagttcaaacatacaaaatttgtgattttacttaactattgtgtaactttcataaaacaatgtgattcgtgtttttaattaattcacgaaaactggaatcgtaaaggtgatgacgtgacccaagaagaacgctttgagcaacggatagcccaggaaacggctatcgagccacaggactggatgcccgatgcttaccgaaagacattgatccgccagattgggcagcatgcgcactccgagattgttggtatgttgcctgaaggtaactggatcactcgcgcaccaaccttgcggcgtaaagccattctgttggccaaagtgcaggatgaagccggtcatggtctgtatctctatagcgccgccgaaacactgggctgcgccagagaagacatctaccaaaaaatgctcgacggacggatgaaatattcctccatctttaattatccgacattgagttgggctgatatcggtgttatcggctggctggtggatggcgcagcgatcgtcaatcaggtggcgttatgccgcacttcttatggcccgtatgccagagcaatggtgaaaatctgcaaagaagagagttttcaccagcgtcaggggtttgaagcctgcatggcactggcgcagggcagcgaagctcaaaagcagatgttgcaagacgccattaaccgtttctggtggccagccttaatgatgttcgggccaaacgatgataactcgccaaacagcgccagaagtctcacctggaaaatcaaacgtttcaccaacgacgaactccgccagcgtttcgtggataacaccgttccacaggttgaaatgctcggtatgaccgttcctgacccggatctgcattttgacactgaaagcggtcactaccgctttggtgagatcgactggcaggagtttaacgaagtaattaacggtcgcggaatttgtaatcaggagaggctcgacgccaaacgtaaagcctgggaagaaggtacctgggtacgggaagcagcgctggcccatgcacaaaaacaacatgcccgtaaggtcgcataaggagattcaaaatgagtaatgtttactggccgttatacgaagttttcgtgcgtggcaaacagggcttatcacaccgccatgttggcagtttacatgctgccgatgagcggatggcactggaaaatgcccgtgatgcttacacccgtcgtagcgaaggatgttcaatttgggtggtgaaggcgagtgaaattgttgcctcgcaaccggaagaacgcggtgaattttttgatccggctgaaagcaaggtctatcgccatccaacgttttacaccatccctgatggcattgagcacatgtgaggtcggaaatgaatcagttaacggcttacaccttgcgcctgggcgataactgcctggtgctctcccagcggttgggtgaatggtgcggtcacgcaccggaactggaaatcgatctcgcactggcaaacattggcctcgatttattaggtcaggcacgcaacttcttatcgtatgccgctgaattagcgggagaaggcgatgaagataccctggccttcacccgagacgagcgccagttcagcaacttattgttggttgaacaaccaaacggcaattttgccgacaccattgcacgccagtatttcatcgatgcatggcatgtggcgctctttacccgtctgatggaaagccgtgatccgcaactggcggcgatttctgccaaagcaattaaagaagcgcgctatcacctgcgttttagtcgtggctggctggagcgactgggcaatggtactgacgtatcagggcaaaagatgcagcaggccatcaacaagttgtggcgttttaccgccgaactgttcgatgccgacgagattgatattgcactgagtgaagagggtattgcggttgatccacgcactttacgcgcagcgtgggaagccgaagtttttgccgggatcaacgaagccacattgaacgtaccgcaagagcaggcgtatcgcactggcggtaaaaaaggactgcataccgaacaccttggacccatgctggcagaaatgcagtatctccagcgtgtcttgcccggtcagcaatggtaacagaggagatgggtatgcaacgtctggccaccattgcaccgccacaggttcatgagatatgggcgctactcagccagatcccggacccggagatcccggtgctgaccattactgatttaggcatggtgcgtaatgtgacacagatgggagaaggatgggtgatcggctttacgccgacatattccggttgtccggcaacggaacatttgattggcgcgatacgtgaggcaatgacaaccaacgggtttacccccgttcaggttgtgctgcaactcgacccggcatggaccaccgactggatgacccccgatgcccgtgagcgtctgcgagagtatggcattagcccgcccgccggacacagttgccatgcccatttgccgccagaagtacgttgcccgcgctgcgccagcgtccataccacacttatcagtgaatttggttccacggcctgcaaagcattgtaccgctgcgatagttgccgcgaacctttcgattatttcaaatgtatttgaggatgccatgacaacgtttcattccttaacagtggcaaaagtcgagtcggaaacccgtgatgcggtgaccattacctttgcggtgccccagcctttgcaggaggcgtatcgctttcgccccggtcaacatttgaccttaaaagccagctttgatggtgaagaattacgccgttgttactccatttgccgcagctatctgcctggcgaaattagtgtggcggtgaaagccattgaaggcggacgtttctcccgctatgcccgcgaacacatccgccagggtatgacgctggaggtcatggtgccgcaggggcatttcggctatcagccgcaggccgaacgccaggggcgctatctggcaattgcagcaggatcaggtattacgccaatgctggcgattatcgccaccactttacaaaccgagcctgaaagtcagttcaccctgatctacggtaaccgtaccagccagagcatgatgtttcgccaggcactggcagacctgaaagacaaatatcctcagcgtttacagttgttgtgcattttcagtcaggaaaccctcgacagcgatctgcttcacgggcgtattgacggtgaaaaattacagtcacttggggcctcgctcattaattttcgtctttatgatgaggcatttatttgtggtccggcggcgatgatggatgacgcggaaaccgccttaaaagcactgggaatgccagataaaaccattcatctggagcggtttaatacgcctggcacgcgcgtcaaacgtagcgttaacgtgcaaagtgacggacaaaaagtgactgtacgtcaggatgggcgggatcgggaaatcgtgcttaatgccgacgatgaaagcattctcgatgcggcattgcgccagggggcggatctgccctatgcctgcaaaggcggcgtctgtgcgacctgcaaatgcaaagtgctgcgtggcaaagtggcgatggaaaccaattacagtctggaaccggatgaactggccgcaggttatgtgttgagttgccaggcactgccgctgaccagcgatgtggtggttgactttgacgcgaaggggatggcatgagcgaactgatcgtcagccgtcagcaacgagtattgttgctgacccttaaccgtcccgccgcacgtaatgcgctaaataatgccctgctgatgcaactggtaaatgaactggaagctgcggctaccgataccagcatttcggtctgtgtgattaccggtaatgcacgcttttttgccgctggggccgatctcaacgaaatggcagaaaaagatctcgcggccaccttaaacgatacacgtccgcagctatgggcgcgattgcaggcctttaataaaccacttatcgcagccgtcaatggttacgcgcttggggcgggttgcgaactggcattgttgtgcgatgtggtggttgccggagagaacgcgcgttttgggttgccggaaatcactctcggcatcatgcctggcgcaggcggaacgcaacgtttaatccgtagtgtcggtaaatcgttagccagcaaaatggtgctgagcggagaaagtatcaccgctcagcaagcacagcaggccgggctggttagcgacgtcttccccagcgatttaaccctcgaatacgccttacagctggcatcgaaaatggcacgtcactcgccgctggccttacaagcggcaaagcaagcgctgcgccagtcgcaggaagtggctttgcaagccggacttgcccaggagcgacagttattcaccttgctggcggcaacagaagatcgtcatgaaggcatctccgctttcttacaaaaacgcacgcccgactttaaaggacgctaatgatggaattcatcctcagtcatgtagaaaagggcgtgatgacactaacgctcaaccgcccggaacgcctgaacagttttaatgatgagatgcacgcacaactggcagagtgcctgaaacaggtcgagcgcgacgacactatccgttgcctgttacttacaggtgccgggcgcggattttgtgctggtcaggatcttaacgatcgtaacgttgatcccacaggccccgcaccggatttagggatgtcagttgaacgtttctataacccactggtacgtcgcctggcaaaactgccaaaaccggtgatctgtgcagtcaatggcgtggcggcaggggcaggcgcaacactggcactggggggcgacatcgttattgctgcccgttcagcaaaattcgtcatggcgtttagtaagttaggcttaatacccgattgcggtggaacctggttactgccacgcgttgccggacgagcgcgcgccatggggctggcactgctggggaatcaactgagtgctgaacaggcgcacgaatgggggatgatctggcaggttgttgatgatgaaacgctggcagataccgcgcaacagctggcacggcatctggcgacacaaccgacatttggtcttggacttatcaagcaagcgataaatagcgctgaaaccaatacgctcgatacgcaactggatctggaacgtgactatcagcgacttgccggacggagcgcagattatcgtgaaggtgtcagtgcgttcctggctaaacgctcaccgcagttcacggggaaatagcatgatgataaatgtgcaaactgtggcagtgattgggagcggcaccatgggggcaggcattgctgaagttgctgccagtcatggacaccaggttttactgtatgacatttctgctgaagcgctgacccgcgcaatcgacgggatacacgcgcggctaaattcacgcgtgacgcggggaaaactgactgctgaaacctgtgaacgcacattgaaacgcctgatcccggtgaccgatattcacgcgctggcagctgcggacctggtcattgaagcggcgtctgaacgtctggaagtcaaaaaagcgctctttgcacagctggcggaagtttgcccgccacaaacgctattgaccactaacacttcgtcaatctctataaccgcgattgctgcggagataaaaaatcctgaacgtgttgcggggctgcatttttttaacccggcaccggtgatgaagttggtggaggtggtcagtgggctggcaacggcggcggaagttgttgagcagttgtgtgaactaacgttgagttggggtaagcagcctgtgcgctgtcattcgactcctggatttatcgttaaccgtgttgcgcgtccttattattccgaggcctggcgggcactggaagagcaggttgctgcaccagaagtgattgacgctgcacttcgcgatggcgctggtttcccgatggggccgctggaattaaccgatctgattggtcaggacgtcaattttgctgtcacctgttcggtgtttaacgctttctggcaggagcgtcgttttttaccttcgctggtgcaacaggaactggtgattggtggacggttgggcaagaaaagtgggctgggcgtgtacgactggcgcgcggaacgtgaggcagttgttggcctggaagcggtaagcgacagttttagcccaatgaaagtagaaaagaaaagtgacggtgtcacggaaattgacgatgttttattgattgagacacaaggcgagacggcacaggcgctggcaatacgactggcacgcccggtggtagtgatcgataaaatggcgggcaaggtggtgaccattgctgctgcagcggtgaacccggactcagcgacccgcaaggccatttattacctgcaacagcagggcaaaacagtgctgcaaattgcagattacccaggaatgctgatttggcgaacggtagcaatgatcatcaatgaagcccttgatgcgcttcaaaaaggcgtggcctctgaacaggatatcgataccgccatgcgtcttggggtgaattatccatatggcccacttgcctggggagcgcaacttggctggcagcgaatattaaggctccttgaaaatctacagcatcactatggcgaagaacgctatcgcccatgttcattgctgcgccaacgggcgcttctggagagcggttatgagtcataaggcctggcaaaatgcccatgcaatgtatgagaacgatgcctgcgccaaagcgcttggcatcgacattatctcaatggatgaaggctttgctgtagtgaccatgaccgtcactgcacaaatgcttaacggtcatcaaagttgccacggcgggcagctattttcactggctgatactgcctttgcctacgcctgcaatagccaggggctggcagccgtcgcttctgcctgcacgattgattttttgcgtccaggctttgccggagacaccttaactgctactgcgcaggtacgtcatcagggcaagcaaaccggtgtttacgacatcgaaattgttaaccaacaacaaaaaacggttgcgctgtttcgcggtaaatctcaccgcatcggcggcaccattacaggagaagcctgatgcgtgaagcctttatttgtgacggaattcgtacgccaattggtcgctacggcggggcattatcaagtgttcgggctgatgatctggctgctatccctttgcgggaactgctggtgcgaaacccgcgtctcgatgcggagtgtatcgatgatgtgatcctcggctgtgctaatcaggcgggagaagataaccgtaacgtagcccggatggcgactttactggcggggctgccgcagagtgtttccggcacaaccattaaccgcttgtgtggttccgggctggacgcactggggtttgccgcacgggcgattaaagcgggcgatggcgatttgctgatcgccggtggcgtggagtcaatgtcacgggcaccgtttgttatgggcaaggcagccagtgcattttctcgtcaggctgagatgttcgataccactattggctggcgatttgtgaacccgctcatggctcagcaatttggaactgacagcatgccggaaacggcagagaatgtagctgaactgttaaaaatctcacgagaagatcaagatagttttgcgctacgcagtcagcaacgtacggcaaaagcgcaatcctcaggcattctggctgaggagattgttccggttgtgttgaaaaacaagaaaggtgttgtaacagaaatacaacatgatgagcatctgcgcccggaaacgacgctggaacagttacgtgggttaaaagcaccatttcgtgccaatggggtgattaccgcaggcaatgcttccggggtgaatgacggagccgctgcgttgattattgccagtgaacagatggcagcagcgcaaggactgacaccgcgggcgcgtatcgtagccatggcaaccgccggggtggaaccgcgcctgatggggcttggtccggtgcctgcaactcgccgggtgctggaacgcgcagggctgagtattcacgatatggacgtgattgaactgaacgaagcgttcgcggcccaggcgttgggtgtactacgcgaattggggctgcctgatgatgccccacatgttaaccccaacggaggcgctatcgccttaggccatccgttgggaatgagtggtgcccgcctggcactggctgccagccatgagctgcatcggcgtaacggtcgttacgcattgtgcaccatgtgcatcggtgtcggtcagggcatcgccatgattctggagcgtgtttgagcatatcaacctgcgagtaccctacaatgataaccaatacaaagcttgacccgattgaaaccgcgtctgttgatgagttacaggcgttgcaaacacagcgtctgaaatggacgctcaaacacgcgtatgaaaatgtgccgatgtatcggcgcaaattcgacgcagcaggcgtacatcctgatgatttcagggaactttcagacctgcgtaaatttccctgtaccaccaaacaggatctgcgcgacaactatccctttgacacctttgccgtgccaatggaacaagtggtgcgcattcatgcttcttcgggaaccacaggtaaaccgacagttgtcggctatacgcaaaacgatattgataactgggccaatattgtagcgcgttctttgcgtgcggcagggggctcgcccaaagacaaaattcatgttgcctatggttacggcctgtttactggtgggctgggtgcgcactatggtgccgaacgtctgggcgctacggtgatcccgatgtctggcgggcagacggaaaaacaagcgcaactgatccgtgattttcaaccagatatgatcatggttacgccatcttattgccttaacctgattgaagagctggagcggcagttgggcggtgatgccagcggttgctcgctgcgggttggagtatttggtgctgagccgtggacacaggccatgcgtaaagagattgagcgtcgcctggggatcaccgcactggatatttatggcctgtcagaagtgatggggccgggggtggcgatggagtgtctggaaactaccgacggcccaaccatttgggaagatcatttctatcctgaaattgttaatcctcatgacggcacaccgcttgccgatggtgaacatggcgaactgttattcaccacgctgaccaaagaagcattgccggtcattcgttaccgcacgcgtgatttaacccgactgttaccaggaacggcgcggactatgcgccgcatggatcgcatcagcggacgcagcgatgacatgttgattattcgcggtgtaaatgtctttccgtcacaactggaagaagagattgtcaaattcgaacatttatcgccgcattaccaactggaggtgaaccgccgggggcatcttgattcactttctgtgaaagtggagttgaaagaaagtagcctgacattgacgcatgagcagcgttgccaggtatgccaccagctgcgccatcggattaagtcgatggtggggatctctaccgatgtgatgatcgttaactgtggcagtatcccgcgttcagaaggcaaggcgtgtcgggtgtttgatctgcgcaatattgttggtgcctgacgtatcgtctggccctggtggggtaaagcgccagggccagaagtcgatacgacctgtgctatgattcataaatcacaacaataacaacagactgaagcgaatgagtaaacttgatacttttatccaacatgctgtaaacgctgttccggtcagtggcacatctttgatctcctctctgtatggtgattcgctttcccatcgtggtggtgaaatctggttgggtagtctggctgctttgctggaagggctgggatttggtgagcgtttcgtgcgcaccgctttgtttcgtcttaataaagaaggctggctggatgtttcccgcatcgggcgacgcagtttctatagcctcagtgataaaggcttgcgcctgacgcgacgggcagaaagtaaaatttatcgcgcagagcaacctgcatgggatggtaaatggctcctgttgctctcggaaggtttagataaatcaacgctggctgatgtcaaaaagcagttgatctggcaaggttttggcgcactggcacccagcctgatggcatcgccgtcgcaaaaactggccgatgtacagacacttttgcatgaagcgggtgtggcggataacgtgatttgttttgaagcgcaaataccactggcgctttctcgcgcagcactgcgtgccagagtagaagagtgctggcatttaactgaacaaaatgccatgtacgaaacctttattcagtcattccgcccgctggtgccgcttttaaaagaggcggcagacgagttaaccccggagcgggcatttcatattcagcttttactgatccatttttatcgccgtgtcgtccttaaagacccattgttgccggaggagttgcttccggcacactgggcagggcatacggcgcgtcagctgtgtatcaacatttatcagcgcgtagcgcctgctgctttagcgttcgttagtgaaaaaggtgaaacctcggtcggtgaactgcctgcgccgggaagcctgtattttcaacgttttggcggcttgaatattgaacaggaggcgttatgccaatttatcagatagacggtctgactccggttgtgccagaagagagttttgtccatccgacagcggtattgatcggcgatgttattctcggcaagggcgtttacgttgggccaaatgccagcctgcgtggcgattttggtcgtatcgtggtgaaagatggcgcgaacattcaggataattgcgttatgcacggttttcccgagcaggatactgttgtaggagaagatggacatattggtcatagcgctatccttcacggctgcattatccgccgcaatgcattagtgggaatgaacgcggtagtgatggacggtgcggtgattggcgagaacagcattgttggtgcatccgcatttgtgaaagccaaagcagaaatgccagctaattacctgattgtcggcagcccggcgaaagcgattcgtgaactcagtgagcaggagttggcatggaaaaagcagggtacgcatgagtaccaggtgctggtgacacgctgtaagcagacgttacatcaagtcgagccattgcgggaaattgaacctggcaggaaacgcctggtatttgatgagaatctgcgaccgaaacagtaacagatgtaaaattattttgtccctttaattataaagcagagttatgtttaagctctgctttatttatttgagtattaattcataccgttttttcatcatataattatttataatgagaatgtggttttaatttgtaatttatattatatacacaatttatatatttcatggtctttttttattcacctgaattataattgtgaattataggaaagtatgtttgattagataataatctactggcaatattggatgtcttctatgttttaaataactaattggtcgggttagtgcatccggctttctttatattcgccagaaggatttattatgcaaaggaaaactctattgtcggcctgtattgcattagctctgagtggtcagggttgggcggcagatatcacagaggtagaaaccaccacaggtgaaaagaaaaataccaatgtgacttgtccggcagacccaggaaaactcagtccggaagagcttaaacgcttaccctctgaatgctctcctttagtcgaacaaaacctgatgccatggctttccacaggcgctgctgcgttaatcacggccttagccgtagtggaactaaacgacgatgatgatcatcatcatcgcaacaattctccactcccaccgacaccccctgatgatgaatcagacgacactccagttcccccaactcctggcggagatgagataataccggacgatccggatgatacgcctacacctcccaaaccggtttcgtttaataatgacgttattctcgataaaacagaaaaaacgttaactattcgcgattcagtttttacttataccgagaatgctgacgggactatatctctgcaagatagcaatggtcgtaaggcaacgattaatctttggcagattgatgaagcgaataacactgttgcccttgaaggggtgagcgcagatggcgcaacgaagtggcaatataatcacaacggtgagcttgttattacgggtgataatgccacagtaaacaacaatggcaaaaccaccgttgacggtaaagattccaccggtacggaaatcaacggtaataacgggaaagtgattcaggacggcgatctggatgtcagcggcggcggtcacggtattgatatcaccggtgacagcgcgacggtggataacaagggcaccatgaccgtcaccgatccggagtccatgggtatccagatcgacggtgacaaggccatcgtcaataacgaaggcgagagcaccatcaccaacggtggcaccggcacccagattaatggtgatgacgccacggcaaacaacaacggcaaaaccaccgttgacggcaaggattccaccggtacggaaatcaacggtaataacggaaaagttattcaggacggcgatctggatgtcagcggcggcggtcacggtattgatatcaccggcgacagcgcaacggtggataacaagggcaccatgaccgtcaccgatccggagtccatcggtatccaggttgacggcgaccaggcggttgttaacaacgaaggcgagagcgccatcaccaacggtggcaccggcacgcagattaacggtgatgacgccacggcaaacaacaacggcaaaaccaccgttgacggcaaggattccaccggtacggaaattgctggcaataacgggaaggtgattcaggacggcgatctggatgtcagcggcggcggtcacggtattgatatcaccggcgacagcgcaacggtggataacaagggcaccatgaccgtcaccgatccggagtccatcggtatccagattgacggcgaccaggccatcgtcaataacgaaggcgagagcactatcaccaatggcggcaccggcactcagatcaacggtaacgacgccaccgcgaataacagtggaaaaaccactgttgatggaaaagattccacgggtaccaaaatcgcgggcaatatcggcattgtaaatctggatggtagcctgactgttacaggcggtgcgcatggtgttgagaacattggtgacaacggcacggttaacaacaaaggagatattgttgtttccgatactggatcgattggcgtgctcatcaacggtgagggggcaacagtatccaatacgggtgatgttaacgttagcaatgaagcgacagggttcagcatcacaaccaacagtgggaaggtttcgctggcaggcagtatgcaggttggcgatttctcgaccggggtagatcttaatggcaacaataacagcgtgacgctggcggcaaaagatctaaaagtggtcgggcagaaagcgacgggcataaacgtttctggcgatgcgaatacagtgaatatcactggtaacgttctggttgataaggataaaaccgcagacaatgcggcggaatatttcttcgatccatccgtgggtatcaacgtttacggcagtgataataacgtgacgctggatggaaagttaactgttgtatcagacagtgaggttacttctcgtcagagtaatttatttgatggcagcgcagagaaaacgtcaggtctggttgtgattggcgatggcaataccgttaatatgaatggtggacttgaactgattggagagaaaaacgcgcttgcagatgggtcgcaggttacttccttgcgcacaggatatagttataccagcgttattgtcgttagtggtgagtcgtcggtatatctgaatggagatacgacaatcagcggagaattccctctggggtttgccggggttattcgggtacaggataaagctttgctggaaattggcagtggcgctacgctaacaatgcaggatattgacagttttgaacatcatgggacaagaaccctggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtgaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgatccggtaaacacgtttggcattgatcgcaggcataccatcaagttctgcctgtctgcgaagcagcgcccatacccgacgataaccatacgttggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatattggttgtctggagattcagggggccagtctaaaccccagaacttacttatgctgattccggtgcgaaaattgttaataaaggtacttgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctagggcattgggagggcgatttagtctcaggtacaaaaaactctcatatagccacacttgtagaccgaaaatcacgttatacgatcatccttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaacacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacactgttgaaattcagaatttaggttttgcttttgttactggtgaaaatacaacaggtataaatagtggcacgatctcgttattacaaaatggtaaagatccggcaccgtctcccattgttttactggctactaacggagggagcgccactaatgcaggtacgatcacaggtaaagtgacggaacaacatagcgtatttaacaagtattcaacgggcacatcgaattcatttatttttaataacgatgtcagtagcataacagggttagtcgctcaatcgaatagcacaattatcaatactgacagcggcatcattgatttgtatggtcgtggtagtgtcggcatgcttgctatagcagattcaacagcagaaaatcagggtaaaattacactggattctatgtgggtagatgcaaatgacactaccgcaatgcgagatatagctagcaacagcgccattgacttcggtacaggtgtgggagttggtactgatagttatagtggtgcagggaaaaatgcaacagcaattaaccaattgggcggtgttataactatttataacgccggcgcaggtatggcggcctatggcgccagcaatacagttattaaccaggggacgattaacctcgaaaaaaatggtaattatgacgatagtctggcagcaaatactctggtagggatggctgtttatgagcatggtactgctatcaacgaccagacgggtgttatcaatatcaatgttggtactggtcaggcgttttataacgatggcacaggaacaattgttaactatggtacaatctgcactttcggcgtgtgccaatcggggaatgagtacaataatacagatgatttcacctcactgatctataccggtggcgatacgattacacgaagcggagaaactgtaacgctaaataaatctgctgctgtgactgataagctggctgggaatgttgttaatagcggaacgctttccggtgatcaaattacggtatcaagcggtcttctggaaaataccagcggtggcatcatcaataacttagtaaaacttgacaagggtgccgtcattaaaaatgccggggtgatgacgaataacgtcgatgttagcggtggaatcctcaataatgccggagaaatgactgcgcaaattaccatgaatgctggtgctgatagttcgttagtgaacaacaccggaaccatcaataaaatcgtgcagaacgcgggggtattcaataatagtggcagtgtaacagggcggatgatgtcggctggcggggtctttaataatcaaactgacggggcgattatgagaggtgctgcgctgacaggtactgcagtggcaaataacgaaggaacctggaacctcggaagtagtagtgagggtaacaacaccgggatgctggaagttaataataattcagctttcaataaccgcggcgagtttattcttgataacgacaagaatgctgtgcacatcaaccagtccggtacgctttataataccggtcacatgaacatcagtaattcttcccacaacggagccgttaatatgtggggcggaaatggtcgttttatcaatgacggaacgattgatgtttctgcgaagtcactggtagtcagcgctaataatgccggcgatcagaatgccttcttctggaaccaggataacggggtcatcaacttcgatcacgacagcgccagtgccgtgaaagtcacccacagcaactttattgcccagaatgacggcatcatgaacatcagcggcaccggtgctgtggctatggaaggtgataagaacgcgcagctggttaacaatggcaccatcaacctcggtaccgcaggcactactgacacgggtatgatcggtatgcaactcgatgccaacgccacggcggatgcggtaatcgaaaacaacggcaccatcaatatcttcgccaatgactcgtttgcatttagcgtactgggtacagtaggtcatgtggttaacaacggcacggtggtgattgccgatggggttacgggttctggactgatcaagcagggcgacagcatcaatgttgaaggtatgaacggtaacaacggtaatagcagcgaagtgcattatggcgactatacgttgccggatgtgccgaagcccaatacggttagtgtaacgtcgggaagtgatgaggctggtggcagcatgaacaacctcaacggctatgtcgtcggtaccaacgttaacggcagcgccgggaagctgaaggttaacaatgccagcatgaacggcgtggagattaacacgggctttaccgctggtacggcagacaccactgtgagttttgataacgtagtggaaggtagcaacctgaccgacgctgacgccatcacctcaacgtccgtggtatggactgccaaaggcagcaccgatgccagcggtaacgttgacgtcaccatgagcaaaaatgcctacaccgatgtggcaacagatgcctcggtgaatgacatcgcgaaagcactggatgcgggttacaccaacaacgaactgtttaccagcctgaacgtcggcacgactgctgaactgaacagtgctctgaaacaggtcagcggtagccaggcgaccacggtattccgcgaagcgcgcgtgttaagcaaccgctttagtatgctggcagatgccgcgccgaaagtgggtaacggtctggcgttcaacgttgtcgcgaaaggcgatccgcgtgccgagttaggtaataataccgaatacgacatgctggcattgcgtaaaactatcgacctgagcgaaagccagacgatgagtctggagtacggtatcgctcgtctcgatggtgatggtgcgcagaaagcgggtgataatggcgttacaggcggttatagccagttttttggcctgaaacatcagatgtcgttcgataacggcatgaactggaataacgccttgcgttacgacgttcacaaccttgacagcagccgctcgattgcatttggcaacacgaacaaaacggctgataccgacgtgaaacagcagtacctggagttccgcagcgaaggggcgaagactttcgaaccgagcgaaggactgaaggttacgccatatgcgggtgtaaaactgcgtcacacactggaaggtggctatcaggagcgcaatgccggagactttaacctgaatatgaacagtggcagcgaaacggcggtggacagcatcgtcgggctgaaactggactacgcaggtaaagacggctggagcgctagcgctacgctggaaggcgggccgaacctgagctacgcgaagagccagcgtacggcaagcctggcaggcgcaggcagtcagcactttaacgtcgatgacggtcagaagggcggcggcatcaatagcctgacaagcgtcggcgtgaagtacagcagcaaagaaagttcgctgaatctggatgcgtacaactggaaagaggatggcatcagcgataaaggcgtgatgctgaacttcaagaaaacgttctaatttttagcatgtgatccctaaaccgcaacgctgatacaggttgcggtttttttattgccggatgtggtacgtgacgcgttttgttttgtgtctttcaggacaatagagcaactcatccagtaatcttgtttacaccttcgcattatttatctcttttcgtttctatactgatttttcttaatccgttttattacagggcagggtgcgatgagcagcaatacatttactctcggtacaaaatccgttaaccgtcttggttatggcgcgatgcaactggcaggtcctggagtttttggccccccacgagatcgccacgtcgctataaccgtgctgcgtgaggcgctggcattgggcgtcaatcatattgataccagcgacttttatggtccgcacgtcaccaatcagattatccgcgaagcgctttatccttactctgacgacctgacaattgtcactaaaattggtgcgcggcgtggagaggacgcatcctggttgcccgcattttctccggcagagctgcaaaaagcggtgcacgataatctacgtaatctcgggctggacgtgctggatgtggttaacctgcgcgttatgatgggggatggtcatggcccagcggaaggatcgattgaggccagcctgaccgtgctggcagagatgcaacaacaaggcctggtaaaacatattggcctgagcaacgtcacaccgacgcaggttgcagaggcgcgcaagattgccgaaattgtctgtgtgcaaaacgaatacaacatcgcgcaccgtgctgatgatgcaatgattgatgctttggcccacgatggcattgcctacgtgccgttcttcccgctcgggggctttacaccgctgcaatcgtccacactttccgatgttgctgcgagcctgggtgcaacaccaatgcaggtggcgctggcgtggctgttacagcgttcaccgaatattttgctgatcccagggacgtcttcggttgcgcatttacgggagaatatggctgctgaaaaattgcatctttctgaggaagtgttgtctacgttggatggtatttcgcgagaataacgaatatacaaaagggaaagatgcatttccctttttttcttttttaatggcatggagtgcatatgttgaaggccaggaattgcggctggatacgtttactgcccctgtttatgctgagtctaccagtacaggcggaacttcgatgtgttgcaaatgcagttgatattgaatcatttttttctgcggctaccgctgaagataaacaacaagttgaacaagctatcaacagtagcgtgaatcttgtccccttcggtttatctgcatcgaactggaaagtgcatcgtggcgatttagtggtagaaggtaatatagagagtaatcaaaaattgattgttcttgggaatttgacagtcaaaggtaatatttccactttctctctttctaatccatgggttattctcggtaacgtgacggcaacgaatatagttgcggattcaccactgttaattaccggttcgataaatgcaagtggactggtatttatcgactcatattacgataatccgtctacgattaaggggagtattaatgcgcgtgggatatttatcaatgacataattgcacctgttgttgcgtcttcgacaaatagtgaattcatggtccgtgcgagtgacaaacatgacactgaaaatgtcaaaaaagcgctgatgataataaatcctgatgcatattattgggggctaattaatgatgaagatgctctgaaagaaatttttaagcgaagcaatattcgcatggcagggaatgtctgtaatcagatgaaaaaagaagcgctgtttcgccctaagccttctcctgagttagtgcaagaattgcaaatgctggatgaaggcaaagttgctgcatttgaaggacgagacattgcgacatttgatcttgccgtaatgcgaactctcccaaggcttaaaggaatttcagctaacctacgcaaacaacttattaatagcaatgatgaacaaacgattgaaagtatggcgagatatatgcctgacaatgagattctggagttgaccgatcagcaattgggttaccagcctgttgttctggggttgctcgaccgtgaaccgctctctgtcgaaataatgacgcgaatgagtcgtctacctgatggtgtcggtccgttgaatcttgcgctacgtgaaaatctccctctggatatcgtcatgactctggcgaaaagagattgggatatgatcattcaggagctttataaagatgcgtggttattgcctgaatccattattgatggctatatccgcagtgatgattcctctattcgtcaggtcggtgctggaggacaactcacctacaatcaggcaatgcagttggcgaacgattcatcaaacaatgttgtcacaagcttagcgttcaagctggcagagatgaaacaccatggtcaattgttgcggatgacgccacaagagagtgacaaagttgcaggctatttataccaaaaattcgagaatgacgatgatctaatacgtgtgttatttttagcattgccagataacttacagtttaattttgttaaaaggatggagaaaaaatccccggcctacttttgctgtcgggatatgcaggtaattcactctgacgctgctttacaacggttattgacacgtttcaacgatcctgaagggtggagtaatctggcgaaaaatcagtatctgagcacgtcgatgaaacaaaaaatttggcaacgtgctttatcgcatcggaaaaataatccgaaagcagattcagatgcatatgaaaccagcgctgatatgattttgtctgagctgattagccacggcgaagttgatgaccagatgctattaaatgccaccgccctgatacgttcggacgactgggactttttagagagtgcattaattagttgggataatttacccgctgttgttctcaaggaattacagcaaaacacgccacgcaatgatatttgggcgaagttttttctgaggcaggaaaacagttcccgtgcgcaggttgacgaagcgttacgtgtttattatgcactagaccccgatgcgttagcacaactggatgtactggcaaaacaaccggatcgtatatggtggagtacactggcgaaaagcaatctcacatttttcaagttcggcgcacttaacaaccgccacacaccgcctgcagtactggcggcagaaattgatcccgagtggtggattgtggcgatgaataatccccgttttccagttgatgtattaaaggcgaggctgaaacgtgatcctttgctggcgttagagcttgttaaccctgaactggatttagtccgccagctggcgcttaacggtaagacgcgcgcaatacgggaacaagcgatgagaaaacttgatgagttgtattgatccacaacgtaatgttttttaactatctgattaattggggataatcattcctgacagtgagtccccaataccttgatatattctgaatttttaatgaaacggcgtgttgcgatatctccgtcaggggaattgatgcaccatagcgcaaaccgaattatcaaggattgataatgacgctctaccagataaaaccgctctttcagtcgctgttaaggccgacgatgttttggctttataagcaccacgttacagcgaatcacatcactcttgctgcactggcgctttctcttcttaccggattgctgttgatgttggcggcacaacccatcctctttttgctattgcccatcgtgctttttatccgtatggcgctcaatgcgctggatggcatgttggcgcgtgagtgcaaccagcaaacacgtctgggggcgattttgaatgagactggcgatgttatttccgatattgcgctctatttaccatttttatttttaccggaaagtaacgcatcactcgtgatactcatgttattttgcaccatattgaccgagttttgcggtttactcgcgcagacgattaacggtgttcgcagttatgccggtccatttggcaaaagcgatcgcgcgttaatatttggtctgtggggtctggccgttgccatttatccacagtggatgcagtggaataatcttttatggagcattgcttcaattctgcttctctggactgcgattaatcgttgtcggagtgtgcttcttatgagcgctgaaatataatgctggaaaaatctctggcaacacttttcgcgttgttaattttagcaacgctgataaaccgttttctgctatggcggttaccggagagaaaagggggtgaggttacattacgtattcgtacctggtggggcatcgtcatttgtttttcaatggtgatttcaggtccacgctggatgacgttgacgttttttgcgctgataagttttctggcattgaaagaatattgtacgcttatatctgtacattttccgcgttggttatattggggtattcctcttaactatttgcttatcggttttaattgctttgagctgtttctgttatttatacctttggctgggtttctgatattagccaccgggcaagttttagtgggtgacccctctggttttctgcataccgtgagcgccattttttggggctggataatgaccgttttcgccttgagtcatgccgcctggttattaatgttgccaaccacaaatatccagggcggggcgttactggtgttatttcttttggcattaaccgagtcaaacgatattgcacagtatttatggggaaaatcctgcggcagaagaaaagtggtccctaaagtcagcccgggaaaaacattggaaggtctgatgggcggcgtcatcaccatcatgattgcgtcactgattatcggaccgttactgacaccgctaaatacattacaggcattattagcgggtttgttaattggtattagtggtttttgcggcgatgtcgtgatgtcagccatcaaacgagatattggtgttaaagatagcggaaaactattgccaggacatggcggactccttgacaggattgactcattaattttcaccgctccggtatttttttattttatacgctactgctgttactgaaggaaaatagagaaaatggaaaattcacgcatccctggggaacatttttttaccaccagtgataatacagcgttgttttatcggcactggcccgctttacagcccggggcgaaaaaggtcatcgtcttatttcatcgcgggcatgaacattctggtcgtctacaacatctcgttgatgaactggcgatgccagatactgctttttatgcctgggatgcccgagggcatggaaaaagttcggggccgcgtggttatagcccatctcttgcgcgttcagtgcgggatgtcgatgaatttgtccgttttgctgccagcgacagccaggttggactggaagaggtggtagtgatcgcgcaaagcgtcggcgcagtgctggttgccacatggattcatgattatgcacctgcaattcgcgggctggtgctggcttctccggcctttaaggttaaattgtatgtgccgctggcacgtcctgcgctggcgttatggcatcgtctgcgtggtctgttttttattaattcctatgtgaaaggacgctatttgacccacgatcggcaacggggggcgagtttcaataatgatccgctgatcacacgggcgattgccgttaatatcttgctcgatctctacaaaacgtctgaacgtattattagagatgcggcggcgattacgctccccacgcaacttctgatatcaggcgatgactatgtggtgcatcgccaaccgcagattgatttttatcagagattacgtagccctctgaaagagctgcatctgctgccaggcttttatcacgacacgttgggtgaagagaacagggcgctggcatttgaaaaaatgcaaagctttattagtcgtttatatgctaacaaatcgcaaaaatttgattatcagcatgaagactgcacaggaccatcagcggatcgatggcggctactttctggtggacccgtgccattatcgccggttgatttagcgtatcgctttatgcgaaaggcgatgaaattgttcgggacgcactcttcgggcctgcatctcggaatgagcaccggctttgattcaggcagttcgctggattatgtctatcaaaatcaaccgcaaggtagtaacgcattcgggcgtttagtcgacaaaatctacctgaacagtgttggctggcgcggtattcgccagcgcaaaacccatttacaaatactgattaaacaagccgttgccgatctccacgccaaaggtttagccgtccgcgtggttgacattgccgcagggcatgggcgctatgtactggatgcgctggcaaacgagcctgccgtaagcgatattttgttacgtgattacagcgagttaaatgttgcacaggggcaagagatgattgctcaacggggaatgtctgggcgggtgcgttttgaacagggcgatgcgtttaacccggaggaactcagcgcgttaactccgcggcctacgctggcgattgtctctggcctgtatgagctttttcccgaaaatgagcaggtaaaaaactcactcgcaggtcttgccaatgccatcgaaccgggcggcattctcatctacaccgggcagccgtggcaccctcaactggagatgattgccggggtgttaaccagtcataaagatggtaaaccgtgggtaatgcgcgtgcgttcgcaaggggagatggattcactcgtgcgtgatgccggatttgataaatgcacacaacggattgatgagtggggtatttttacggtttcgatggcggtgcgtcgtgataactgaacgtcggaacgtattgctacaaggcgctggctggttattgttgctggccccgtttttcttcttcacctatggatctcttaatcagttcaccgcggttcaggaccttaacagccatgatatccccagtcaggtattcggttgggaaacggcgatcccttttcttccctggactattgttccttactggagtctggatcttttatatggattttcgctgttcgtttgtagcacgacattcgaacagcgccgacttgtccaccggcttattctggcaacggtaatggcctgctgcggttttttgctctatccgctgaagtttagttttatccgtcctgaagtgagtggggtgacgggatggctattttcgcaacttgaactgtttgatctgccttataaccagtctccttcgctgcatattattctctgctggctactttggcgtcactttcgtcagcatctggctgagaggtggcgtaaagtctgcggcggatggtttttactcatcgccatttcgacgctgacgacctggcagcatcattttattgatgtcatcacagggctggcggtaggtatgttgattgactggatggtgcccgtcgaccgtcgttggaattatcagaaacctgatcaacgtcgaatcaaaatagcactgccctatgtcgtaggcgcgggctcgtgcattgtattgatggagctaatgatgatgattcagttatggtggtcagtctggttatgttggccagtattatcgctactcataattggccgtgggtacggtgggcttggcgcgataacaacagggaaagatagtcaggggaaactaccgcccgccgtttactggctgacattgccctgccgcatcgggatgtggctgtctatgcgttggttttgtcgtcgcctggagccggtgagcaaaatgactgctggtgtttatttaggggcgtttccacgacatattccggcacagaatgcggttctggacgtcacctttgaattccctcgcggacgagccacaaaagatcgactctatttttgtgtaccgatgctggatctggtggttccggaagagggggagctccgacaggccgtggcgatgctggaaacattacgcgaagagcaaggcagcgttctggtccattgtgcattgggattatcgcgcagtgcgctggtggtggcggcatggttgttatgttacggacactgtaaaaccgttaatgaagcgattagctatattcgagccagacgcccgcagattgtgctgacagacgagcacaaagcgatgctgagattatgggaaaacaggtaagtggattgagatgtggactgaatatctacagtccacatcaagaccgtgtccggttatgcagaaacaatgctgtcgatggctgcttttgcgtcagactgtgctttcgctgccatttccggaccgtatgcgatcccttcggcgaagacaaatttcacatcggtaatgccgataaagccgaggaacgtggacagatacggcgtcaccaggtccgttggtccatctttgtggatcccgccgcggctggtaataacgatggcttttttacccgttaccagaccttccggaccgttctcggtatagcggaaagtaacgcctgcgcgggcaaccaggtcaaaatagtttttcaactgagtcgagatgttgaagttatacatcggtgccgcaataacgataacgtcgtgggctttcagctcggcaatcaactcatcggaaagtgccagagcttcctgctgacgcggagtcagcggcgcatcgctcggacgcagagcgccaaccagttcgccatccagtaccggaatcggatttgcagccaggtcgcgaacggtgatttcatcagcggagtgcttttcgcgccattgttcaacaaaataatcggacaactgattagactgagagtaccctgccaggatgctggatttaagaactaataccttgctcatggtgtttccttatagatgtttgaatgggcgatgccccgttgcttgttgacactttattcacaatcctgccacagagatagcgcaataaatcgaagcctatgttcgaatttattgaacaacgcatagaaagccgcgatgtggtactctatatctatcatttaaaagaaaattaatcaggcagactactgcccactaacgttatgacagaacaacaaaaattgacctttacggccttgcagcagcggctggattcgctgatgctgcgtgacagactgcgtttttctcgccgtctgcacggcgtgaagaaggttaaaaatcctgatgcacaacaggccattttccaggagatggcgaaagagattgaccaggcggcagggaaagtcctgctgcgtgaagcggcacgaccggaaattacttatcctgacaatttaccggttagtcagaaaaaacaggacattctcgaagcgattcgtgatcaccaggtggtgatcgtcgccggggaaacgggttctggtaaaacgactcagttaccgaaaatctgtatggagctggggcgcgggattaaaggactgatcggccatacccagccgcgtcgtctggcggcaagaacagtggcgaaccgtattgcggaagagctgaaaacggagccgggcggttgcatcggttacaaagtgcgtttcagcgatcacgtaagtgataacacgatggtcaagctgatgaccgacggtatcctgctggcggagatccagcaagaccgcctgctgatgcagtacgacactatcattattgacgaagcgcacgaacgcagcctgaatatcgattttttgctcggctatttgaaagagttgctgccgcggcgtcctgacctaaaaatcattatcacttccgcgactatcgacccggaacgcttttcgcgccactttaataatgcgccgattattgaagtctccggtcggacctatccggtggaagtgcgctatcgcccgattgttgaagaagccgatgacaccgagcgcgatcagttgcaggcgatttttgacgccgtagacgaactgagtcaggaaagccatggcgacattctgatctttatgagcggcgagcgggaaatccgcgataccgccgatgcgctgaacaagctgaacttacgccataccgaaatcttgccgctttatgcgcggctttcgaacagcgaacaaaatagggtattccagtcgcacagcggacggcgcattgtgctggcgaccaacgtcgcggaaacgtcgctgaccgtaccggggattaaatacgttatcgaccccggtacagcgcgtatcagccgctacagctatcgcaccaaagtgcagcgtttgccgattgagccgatttcccaggcgtctgccaatcagcgtaaaggccgctgtggtcgtgtgtccgaagggatctgtattcgtctctattccgaagacgatttcctctcgcgcccggagtttaccgatccggagattctgcgtaccaacctggcctcggttattttgcagatgaccgcgctggggctgggcgatatcgctgcgttcccgtttgtcgaagcaccggataaacgcaatatccaggatggcgtgcgtctgctcgaagagctgggcgcgatcaccactgatgaacaggccagcgcctataaactgacgccgctcggtcgccagctctcgcagttgcctgtcgacccacgtctggcgcgtatggtgctggaagcgcaaaaacatggctgcgtgcgtgaggcgatgattatcacgtccgcgctctccattcaggatccgcgcgaacgtccgatggacaaacagcaggcatcggacgaaaaacatcgtcgcttccacgacaaagagtctgactttctcgcgtttgtgaatctgtggaattatcttggcgagcagcaaaaggcgctttcttccaacgccttccgtcgcctgtgtcgtaccgattatctcaactatctgcgcgtgcgcgaatggcaggatatctacacccagttgcgtcaggtggtgaaagaacttggcattccggttaacagcgaaccggcggagtatcgcgaaattcacattgcgttgctgaccggtttactttcccatatcggcatgaaagatgccgataaacaagaatataccggcgcacgtaacgcgcgtttctccatcttccccggttctggtttattcaaaaaaccgcctaaatgggtaatggtggcggaactggtagaaaccagccgcctgtgggggcgcattgctgcgcgtatcgacccggaatgggtggagccagttgctcagcatttgattaaacgcacctacagcgaaccgcactgggaacgggcgcagggcgcggtgatggcaacggaaaaagtcactgtttatggtttgccgattgttgccgcgcgcaaggtcaactacagccagatcgatccggcgttatgtcgtgaactctttattcgccacgcgctggtggaaggtgactggcagacgcgtcacgcattcttccgtgaaaacctgaaactacgggcggaagtagaagagctggaacacaaatcacgtcgccgcgatattctggttgatgacgaaacgttgtttgagttctacgaccagcgcatcagccacgatgtaatctccgctcgccacttcgacagctggtggaaaaaagtcagccgcgaaacgcctgatttgctcaactttgaaaaaagcatgttgatcaaagagggcgcagaaaaaatcagcaagctggattacccgaacttctggcatcagggcaatctcaagctgcgtttgagctatcagtttgagcccggcgcggatgctgacggtgtgaccgtacatattccgctgccgttacttaaccaggttgaggaaagcgggtttgaatggcagatccccggtctgcgccgcgaactggtgattgctctgattaaatcgttgccgaaaccggtacgccgtaattttgtacccgcgccaaactatgccgaagcgtttttaggccgcgtcaaaccgctggagttaccgttgctcgacagccttgagcgcgagttacggcggatgaccggcgttaccgttgaccgcgaagactggcactgggatcaggtgcccgatcacctgaaaattaccttccgcgtggtggatgacaaaaacaagaagctaaaagaagggcgctcgctacaagatctgaaagatgcgctgaaaggcaaagtgcaggaaacgctatctgcggtggcggatgacggtatcgagcagagcggcttacatatctggagttttggtcagctgccggaaagctacgaacagaagcgtggcaactacaaagtgaaggcgtggccggcgctggtggatgagcgcgacagtgtggcgatcaaactgtttgataacccgctggagcaaaagcaggcaatgtggaacggtcttcgccgtctactgctgctgaatattccatcgccaatcaaatatttacatgaaaagttaccgaacaaagccaagctgggactgtactttaacccgtatggcaaagtgctggagctgatcgacgactgtatctcctgcggtgtggataaattgatcgacgccaatggtggcccggtctggacggaagaaggctttgctgcgctgcatgaaaaagtgcgtgccgaactgaacgacacggtggtggatattgcgaagcaggtcgagcaaatccttacggcagtgttcaatatcaacaaacgtctgaaagggcgggtggatatgaccatggcgctggggctttctgacattaaagcgcagatgggcgggttggtatatcgcggttttgtcactggtaacggcttcaaacggctgggcgacacgctgcgatatttgcaggcgattgaaaaacggctggaaaaactggcggttgatccacatcgcgaccgtgcgcagatgctgaaagtcgaaaacgtccagcaggcgtggcagcaatggatcaacaaactgccgcccgcacgtcgtgaggatgaagacgtgaaagagatccgttggatgatagaagagttgcgcgttagttacttcgctcaacaacttggtacgccttatccgatttcagataagcgtattttgcaggcgatggagcagattagcggttaaccctgctatttgcctgataaagaaaaaacccggtaagcatttagcgccgggttttttattaattctaaaacggtaagggtaaaaattcaggaattcagaaaaatacaattctctgctgcaagatgaataatgtttatctacagcatttccttaaaagatatgtcaggcttgcggagtggcggttaaggacatacgatttcctcctttcagagtgctccgcttctcactattatctcacgcagtattcttaagggaacgataaggaggaaccatgaacattaccccgtttccgacgctttcgccggcaactatagatgccataaatgttatcggacagtggctggcgcaggatgatttctccggtgaggtgccgtatcaggccgattgcgtgatccttgcaggcaatgcggttatgccgactatcgatgcggcatgtaagattgcccgcgatcagcaaattcctttactgattagtggtggtatcggtcactcgacaacttttttgtatagcgccatcgcacagcatccgcactacaacactatccgcaccactggcagagcagaagcgaccatcctggcggatatcgctcatcagttctggcacattccgcatgaaaaaatctggattgaagaccagtcaacaaactgcggtgaaaacgcacgctttagcatcgcgctattgaatcaggccgtagaacgagttcatacggctatcgttgttcaggaccccaccatgcagcggcgcacgatggcgacgttccgccgtatgactggggacaatcccgatgcaccacgctggttaagttatcccggattcgttcctcagttaggaaataacgcagacagtgtaatctttattaatcagttacaaggattatggccagttgagcgttatctctcactactcactggcgagctgccgcgtttacgcgatgatagcgatggctacggtccccgcgggcgagattttatcgttcacgttgattttccggcagaagtcatccatgcatggcaaacgctgaaacatgatgcggtgctcatcgaggcgatggaaagtcgctcgttacgttaaaaattgcccgtttgtgaaccacttgtttgcaaacgggcatgactcctgacttttatttctgccttttattccttttacacttgtttttatgaagcccttcacagaattgtcctttcacgattccgtctctctgatgattgatgttaattaacaatgtattcaccgaaaacaaacatataaatcacaggagtcgcccatgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaatgagtgaaagaggcggaggttttttcctccgcctgtgcgcgtcagagtttagcgaatttttcgagggtgcgaataagctgtgtgacgaagccatattcgttatcgtaccaggcgaccgttttcaccagttgtaaatcgcccacggcggtaatttccgtttgcgtggcatcaaacaccgaaccgaaatggctgccaatgatatcggaagagactatttcttcatcggtataaccaaatgactcgttattggtggttgcttgtttaagtgcgttattcacctcttcggcagtcacttttttccgagaatcgataccagttcagtgaccgaacctgttttcaccggcacgcgttgcgcatgacctttcagtttgccgctcagttccgggatcaccagaccaatggcttttgccgcccccgtagtgtggggaatgatattttctgccgctgcgcgtgaagcacgtaaatctttaccacgcgggccatccaccagtgactgggtgccagtataggcatgaatggtcgtcatcgtgccgacttctatcccgaaactgtcatgcaaggctttggccatcggcgcaagacagttagtggtgcatgacgccacggaaacaatggtgtcgttgccatccagagtgtcgtcattgacgttataaacgatagttttcatttcaccggcaggggcggaaatcaacaccttcttcgcaccagcatcaagatgcgcctgcgatttctcggcggaggtataaaagccagtacattcgacaatgatttctgcacctttcgctttccacggaatatttttagcctctttttcggcgtaaaccgcgatacttttcccatcaacgataagtgaatcttccgtaaaatcaacgctccaggggaatggtccgtagtttgaatcatgtttcagcaggtaggcgagaatttatggggaagtgagatcattaatagcgacaacgtctatgttgcttttgacttcaagtaatcgacccaacaccagtcgaccgatacgaccaaaaccgttaataccaactttactcatggttttctcctgtcaggaacgttcggatgaaaattgatcctttccaagcttagaccaggatggcgggatgggcaatctccattctcacagtgaaacgtaacgtactgaaaacgggtgaacaatatttaatgaaattttgagaaaagcccgttatgttaacggaaaattatgttaaagcaggaaatgttatggaaaataaatattcaaggttacaaatcagcattcactggctggtctttttactggttatcgcagcgtattgcgcaatggagtttcgtggtttcttcccacgtagcgatcggccactcatcaacatgattcatgtttcctgtggcatctcaattctcgtgctgatggtcgttcgtcttttgttaaggctgaaatacccaaccccgccgattatacctaagccaaaaccgatgatgacgggactggcgcatttgggacatttggtgatttatctcctgtttattgcgctgccagtgattggtttggtgatgatgtataaccggggcaacccgtggtttgcgtttggtttgacgatgccttacgcttcagaggccaatttcgaacgggtagatagcttaaagtcgtggcatgaaacgctggcgaatctgggatattttgtcatcgggttgcacgctgcggctgcactggcacaccactatttctggaaggacaacacacttctacgcatgatgccgcgtaaacgttcctgaaggatatttaaagaaaacgcctgtactaaaaccgacccgtggtacaggcgaagaatacgggtctacatcggaagcgcctattatatttatttgtatgataaataaaaccataatccttgcccatacgtccatctggcttatttttaatcaattcacccgatctttgatctcatcaacggtatcaaaataaaccagcgtataacgttcaaatcgaacataagattcgataaaccatggaggttatatgaaaaaactggcacttattttgtttatgggaacgcttgtttccttttatgccgatgccgggcgcaaaccctgttctggttcgaaaggggggatctcacactgtacggcaggcggcaaatttgtctgtaatgatggttctattagtgcatcgaaaaaaacatgcactaactgaagtgtaaaaggggtgccatgagaaaatgaatctgctagtcaaatgcgcggggaaaatccccgcgcttgcccttacctggacgtgcaggccatgagcgcagcaacctccttatcaccgtcccggaaccgcagttcgtagagcgtttgtcgggtcaggagtgtgaatgtcagaatcgtaatgcagataatgagcagacacaccaccagagggttgtgcttcatagcctttctccttgccggatggcgggtaagaggctaagatctgaattgctaggttcattcgttggcctcggttgatagaaatatcggtcggggccttcgtctttctgattcccggttagcctgaaaacagaaagtctcaggcacccgcaggcatcctatgaggtttccttagggacgaaaataatcacttcacgaaattgcgtgctgttttccagaatttttcgtcattcgggttagccagtttagccattcgttactctcttcattccaatagcattaattttctatgcaataattgttgtaaaaatgtgacgcaaagaggtttttggtcataagtaattaccgtcaagtgccgatgactttctatcaggagtaaacctggacgagagacaacggtaatgaatacaactccctcacagcgattaggttttttgcatcacatcaggttggttccgttatttgcctgcattctaggcggtatcttagttctattcgcattaagttcagccctggctggctatttcctctggcaggccgatcgcgatcagcgtgatgttactgcggagattgagattcggaccgggttagcgaacagttcagattttttgcgttcagcccggatcaatatgattcaggccggggctgcgagtcgtattgcggaaatggaagcaatgaagcgaaatattgcgcaagccgaatcggagattaaacagtcgcagcaaggttatcgtgcttatcagaatcgaccggtgaaaacacctgctgatgaagccctcgacactgaattaaatcaacgctttcaggcttatatcacgggtatgcaacctatgttgaaatatgccaaaaatggcatgtttgaagcgattatcaatcatgaaagtgagcagatccgaccgctggataatgcttataccgatattttgaacaaagccgttaagatacgtagcaccagagccaaccaactggcggaactggcccatcagcgcacccgcctgggtgggatgttcatgattggcgcgtttgtgcttgccctggtcatgacgctgataacatttatggtgctacgtcggatcgtcattcgtccactgcaacatgccgcacaacggattgaaaaaatcgccagtggcgatctgacgatgaatgatgaaccggcgggtcgtaatgaaatcggtcgcttaagtcgtcatttacagcaaatgcagcattcactggggatgacagtagggactgttcgacagggcgcggaagagatttatcgtggcaccagcgaaatttcagctggcaatgcggacctgtcatctcgcaccgaagaacaagcggcggctatcgaacaaactgccgccagcatggagcaactcactgcgacggtgaaacagaatgcggataacgcgcatcatgccagcaaactggcgcaagaggcttctattaaagccagcgatggcgggcagacggtttccggtgtagtaaaaacgatgggcgctatctccacgagttcgaagaaaatttctgagatcaccgccgtcatcaacagtattgctttccagacgaatattctggcactgaatgctgccgttgaagccgcgcgagcgggtgagcaagggcgtggatttgccgttgtcgccagcgaagtacggacactcgcaagtcgcagcgctcaggcggcgaaagagattgaaggcttgatcagtgaatcagtcaggttaattgacctggggtcggatgaggtggcaacggccgggaaaaccatgagcactattgttgatgccgtcgcgagtgtcacacatatcatgcaggaaatcgccgccgcctcggatgaacaaagtagaggcataacgcaggttagccaggcgatttctgaaatggataaggtgacgcaacagaatgcttctctggtagaagaggcctcagcggcggcggtgtcccttgaagaacaggcggcacgattaactgaggcggtggatgtattccgtctgcacaaacattctgtgtcggcagaacctcgcggagcgggtgaaccagttagtttcgctacggtgtgaaaatgttcaaggagggatcgacagatcccttcacctttcagaacggcattgattttcgaatagcgttaatcatcaactggcaaccagaagagaacgtcgcatctacgcgggtcagtattccaatcggttcgcctgcaccatgtcccggaacaggcagggccaccagcgtggcatgacgcaggtcgtcttttacagcgccagaagggacaaaccacacgtaatcgtattcaaccgtaagttgacgagatagcgaagcagacagcgtttcgatacaacccgaaggaattttacagccctggctctgcactaatgcatctgaatgctggcgtggcgcagtgccttctggtgatacaacgaccggccattccagcacccggcttagcgttacgttctcctgaagtagcgggtgattagggcggacaaccagcttcaacgattcaagaaacagcagttcgtaattaagcccggtcatcagttcaggatctgacatccgaccaatgccgatatcgatttccccggtttttaaacccgccagaatcatagggttactcattgtcgcaacttgcaaggtcgtctctttttgttgctgatgaaactgacctataaccgaaggtaatatccccagtgccgcagtaggtagtgcaccaaccctgacgacatcattattaagaccttctttacgatgaagcgaccgtccggcagtgttgatggcgtcaagaactctgactgcatgcgttaaaaattgttcgccgggtaaggtaagttgcgccccctgacgaccacgctcaaacaagcgagcgccagtcagctgctccagttcattcaatgtcttagagagcgcaggttgactcaaattaagggtttcagccgcgcgccccaaagttccttgttgtgcgacagctacgaatgtatgaaggtggcgcaaacggatgcgctgactaaacagactatttttttccataagcgatgttaaaaacgaagcggtgtcgctgacaagtgaagttgtttgattatgataacttgattgcaaaatattattaacaattaaagcaattatgttacagcaaaatggataatattgatgttttcgcggcgagatcacagtttgtaaattcttcccgcaagagtgaatgcggttacctacactccagattactgaccactggaggcagacactatggcgaacagcatcacggcggatgagattcgggaacagttttcgcaggcaatgtcagccatgtaccagcaagaagttccgcaatatggcacgctgctggaactggtagctgatgtgaatctggctgtgctggaaaacaatcctcaactgcacgaaaaaatggtaaatgcagacgagctggcgcgactgaatgttgaacgtcatggggcgattcgcgttgggactgcacaagagcttgctactcttcggcggatgtttgccattatggggatgtacccggtgagctattacgatctctcgcaggcaggggtgccggtacattcgacagcatttcggcccattgatgatgcttctctggcgcgtaatcccttccgcgtttttacctccttactccgccttgagcttatcgagaacgaaattttgcgccagaaagcggcggagattctgcgtcagcgcgatatcttcaccccacgttgtcgacaactgttagaggaatatgagcagcagggcggttttaacgaaacacaggcacaggagtttgtgcaggaagccctggaaacgtttcgctggcaccagtcagcaacggtagatgaagaaacctatcgcgcattgcacaacgaacatcggttgattgctgatgtggtctgttttcctggatgccatatcaaccacctgacgccacgtacgctggatattgaccgggtgcagtcgatgatgcctgaatgcggaattgaacccaaaattctcatcgaggggccgccgcgccgcgaggtaccgattttactacgccagaccagctttaaagcactggaagagacggtgttgtttgcggggcagaaacagggcacgcataccgcgcgctttggtgaaattgagcagcgtggcgtggcattaacgccgaaagggcgacaactgtatgatgatcttctgcgtaacgctggaaccgggcaggataatctcactcaccaaatgcatttacaggaaaccttccgcacttttcctgacagtgagtttttaatgcgtcagcaagggttggcatggttccggtaccgtctgacgccttcgggtgaggcgcatcgtcaggcgattcatcctggagacgatccacagcccttaattgaacgtggttgggtagtggcgcaacccatcacctatgaagatttcttgcccgttagcgcggcggggatcttccagtcaaatctgggtaatgaaacgcagacacgcagtcacggtaatgccagtcgcgaagcatttgagcaggcgttgggttgtccggttttggatgagttccagctttaccaggaagcggaagaacgcagtaaacgtcgctgtggtttgctttaaaatctgaccatccgcctttgcaaaaatttgcctgattttacaaacgaatcaggctcatcccatcgacataaaaaaaatgccgatttatgcatattctctcagttcaacaattggattattaataaatattgtctagagtgagcggtcataaataagcactttcttgccgctgaaaacgaccagcgcgggaccattcacaacaccagaaggactcactttcaggtatggatcgtagacgatttattaaaggttcaatggctatggccgccgtgtgcggtaccagcggcattgcttctcttttttctcaggcggcattcgcggcagattctgatattgccgacgggcaaacccagcgttttgacttctccattctacagtcaatggcgcacgacttagcgcaaacagcgtggcgtggtgcgcctcgtccgttacctgacacgctggcgacaatgacgccgcaggcttataacagtattcaatacgacgccgaaaaatcgctctggcataacgttgagaaccgtcaactggacgctcagttcttccatatgggaatgggattccgtcgccgcgttcgtatgttttctgtagatccagcaacacatctggcgcgtgaaattcactttcgcccggagttgttcaaatacaacgatgcaggtgttgatacaaaacaattagaagggcaaagcgatctcggctttgccggttttcgcgtgtttaaagcccccgaactggcgcgccgtgatgtagtatcatttctcggcgcgagttatttccgcgccgttgatgatacatatcaatacggtttgtcggcccgcggcctggcgatcgacacttacaccgacagtaaagaagagttccccgactttaccgccttctggtttgatacggtaaaaccgggggcaactacctttaccgtttatgcgttgctcgatagcgccagcattactggtgcctataagttcactatccattgtgagaaaagtcaggtgattatggatgtggaaaatcacctgtatgcgcgcaaagacattaaacagctgggcattgcgccgatgaccagtatgttcagctgcggtactaatgaacgtcggatgtgcgatacaattcatccgcaaattcatgactctgatcgtctgtccatgtggcggggcaacggcgagtggatttgccgtccgctgaataatccgcaaaaattgcagttcaatgcttacaccgacaacaacccgaaagggtttggtttattgcaactggatcgtgacttctcccattatcaggacattatgggctggtataacaaacgcccaagtctgtgggtggaaccgcgtaacaagtggggtaagggcaccatcggcctgatggaaatcccaacaacgggcgaaacgctggataacattgtctgcttctggcagccagaaaaagctgtaaaagcaggtgatgagtttgcattccagtatcgtctgtactggagtgcgcaaccgcctgttcattgcccattagcgcgcgttatggcgacgcgtaccggcatgggcggtttctcggaaggttgggcgccaggtgaacactatcccgaaaaatgggcgcgtcgttttgccgtcgatttcgttggtggtgatctgaaagctgccgcgccaaaaggcattgagccggtgattacgctttccagtggggaagcgaagcaaatcgaaattctctatattgaacccatcgatggttatcgtattcagtttgactggtatccgacttcggactccactgatccggtcgatatgcggatgtatctacgttgtcagggggacgctatcagtgaaacatggctgtatcagtatttcccgccagcgccggataaacgtcagtatgttgacgaccgcgtgatgagttaatcgttttttcttcggcaccttcttcgggaggtgccgtctggttaaacacgatcccgctcgcatttttccctaagttaaatgagtaatctgatggtgtgtatttcagatacaccttgtcagccactaacagggagtgcgtatgtttccagaataccgagatttaatatcccgtctgaaaaacgaaaatcctcgctttatgtccttgttcgataaacacaataaacttgatcatgaaattgccagaaaggaaggttccgacggtcgagggtacaatgcggaagtggtccgcatgaaaaaacaaaagctacagttaaaagatgagatgctcaaaatcctgcagcaggagagcgtcaaagaggtgtaaactttcctaagccgccagccaggcggcttttttaacaactgcatggattgactggagataagatgactgaaacgataaaagtaagcgaatcacttgaattacatgctgttgcagaaaatcacgtcaaacctctttatcagttaatctgtaaaaataaaacctggttacagcagtcgctaaactggccgcagtttgttcaaagtgaagaggacacgcgaaaaacggtgcagggtaatgtgatgttgcatcaacgcggctatgccaaaatgttcatgattttcaaagaagatgaacttatcggcgttatctcgtttaatcgtattgaaccactgaataaaaccgctgaaataggctactggctggacgaatctcatcaggggcaggggatcatttctcaggcgctgcaggcattgattcatcattacgcccagtctggtgaacttagacgcttcgtgatcaaatgtcgggtggacaatccgcaaagcaaccaggtcgctttgcgcaatggttttatccttgaaggttgcctgaaacaggctgagttcctgaatgatgcctatgatgatgtgaacttatacgcgcgtattatcgattcacaataaccctgccagcggcgttcgcgtaatgcgctcctcgccgttaatgacttttggaccacggacatgaaccgtgtcgccatcaaaggcttcaacgacggcgtggtcggttaactccacatggttttcaattatcaccgcacctgtaatacggctctcaccttgtatgacaacgtgctcgtcgagcagaatcggtccgccacgtaccacggcatttccgccaaccaagacatgatgttttaacacacaattaccttccacaatggcatattccgccacctgcgaactgtaatgaatcgtcggaatggcatcttcttctatgccagctttcacctgcgcgtgaccgtagactttagcgcaatcgcatagccagacattgttctcttcattaccttcaatactggcaaaatcaaaaacttcggcgcgatgttcaataaaagcataccggacgacggcatcgccataaatttgtgcctggtggacaatacgcgaggcgctaacccttgcgcgatcataaatttggagcaggagttgatggtcgggcgttaagccttgtgcggcgacgatcatagaatgttgatcaattaaggcgtgaccaaatattctacattgcccgtaaactaatgagtcatgaatggtgacgctgtcacttatatatgcaccctggctgatttcactattatcgatccagacgttatccgttgcgtaaacctctccccacagcacgctggtgccggtgatacgcgtattaccggaaatcaccgctccgccgaacgcaatagcattctggtcgtaaatccagcaatttccttcttgtgctaacaccgtttcgcgatcgatccagccgccagcggttcctgctatcacatcgttaaaatcgctaatggcgataatctgccgtaataacacattttttttagtgccatcttcctgataactaaaggctcgctgttcttcacttagacgatatttgcgcatagcgttttcccacaggtgacttactataaccgtagcaaattctgcggctctggctatgctcgagaaaattccataaaatgcatttcaaatatactttataaattaaacaaaatgagtaagaagatgcagagcgataaagtgctcaatttgccggcaggctactttggtattgtgttggggacgatagggatgggatttgcctggcgctatgccagccaggtttggcaggtcagccactggttaggggatgggctggtgattctggcgatgatcatctggggattattgactagcgcatttattgcccgactcatacgctttccgcatagcgtgctggcggaagttcgccatccagtgctgagcagttttgtgagtttgtttccggcaacgacgatgctggtggcgattggttttgttccgtggtttcgcccactggcggtgtgcctgttcagttttggtgtcgtggttcagttggcttatgccgcctggcaaactgcgggattatggcgcggatctcaccctgaagaagctaccacgcctggactgtatctgccgacagttgccaacaactttatcagcgcaatggcctgtggtgcgttgggctacaccgacgccggtctggtgtttttaggcgcaggcgttttctcatggctaagccttgaaccggtgatcttgcagcgtctgcgcagttcgggagaattacccacggcactgcggacatcactcggcattcagctcgctcctgcgctggtggcttgtagtgcctggctgagcgtcaacggcggcgagggtgacacgctggcgaaaatgcttttcggttatggactgctgcaactgctgtttatgctacgtctgatgccatggtatctctcccagccatttaatgcttcattctggagtttctcgttcggcgtatctgcactggcaaccaccggtttgcatctggggagtggcagcgataatggatttttccatacgctggcggtgccgctgtttatctttaccaattttattattgcaatactgctcatccgtacttttgcgcttctgatgcagggaaaattgttagtcagaaccgagcgcgccgttttaatgaaagcagaggacaaagaatgatcattcgtgacgaaaactattttactgataaatatgaattaacccgcacacactctgaagtactggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaaatccattgaaaatctggataatttacacacccgagtcgttgatctgaataacctcacatttgatagacagtacgattttattctttcgactgtggtgctgatgttccttgaggctaaaaccatccccgggttgattgccaatatgcaacgttgcactaaacctggtggttacaacctgattgtggcggcgatggataccgctgattatccatgtaccgtcggcttcccgtttgccttcaaagagggagaattacgtcgatattacgaaggctgggagagggtgaaatacaatgaagacgtcggcgagctgcaccgcaccgacgccaacggtaatcgtattaaactgcgtttcgccacgatgctggcacgtaaaaaatgacccggtaagcacaaaacgcgtgaaaattccccacgctgagatgatttactgttcttcttttcggtaagcatattttttatcgaagggatgtgaaattaatcacagtagtcgaagtttttagcagcttaacttactgaaatttaagtactgatgattgacttagcccctttttcggcattgactatgtcgtctgaaaaggggctgaaaaatttattttcaccaacactttttttgccacaacacgaagcggcgctttttgctataacttagaaagtaatataatcatctcaggaaactattcatgcgtaccacatcatttgcgaaagttgcagctttatgcggcttattggctctgtctggttgtgcatctaaaatcacccagccagataaatattctggttttttaaacaattactctgatttaaaagaaacaacctcggctacaggtaaacctgttttacgttgggtagacccgagttttgatcaaagcaaatatgacagcatcgtctggaacccaatcacttattatccggtaccgaaaccgtcgacccaggtagggcagaaagttctggataaaattttgaactataccaacaccgaaatgaaagaagcgatagcgcagcgtaaaccactggttaccaccgctgggccgcgtagtctgattttccgtggggccattaccggtgtagataccagcaaagaagggctgcaattctatgaagtggttcctgttgcattagtggttgcggggacgcaaatggctacaggccaccgtaccatggatactcgcctctattttgaaggtgagctgattgatgcagcgactaataaaccggttatcaaagtcgttcgtcagggcgaaggtaaagacctgaataacgaaagtacgccaatggctttcgaaaatattaaacaagttattgatgacatggcgaccgatgccaccatgtttgacgttaacaaaaagtagttccagacgcgccatcgttagatggcgctttttatccggtgcgccgtaaaaccccatccttcagggcggggatataaggcgcggttttccacctgaccaggtgtttgctgttgttcaatgtattggcggatgacggatattggcgcacctccgcagctactggcaaaatagccaggactccacaaaacgcctttgtagtaatacctgaatgcaatatctggtcgatctcgtcgcagtcacctacccgatacgcctttgaggctgtttaccagactggatatcgccagtttgggaggatagttaattaacaaatggacgtgatctggttcgccatccatttcaaccagttcagcttcaaaatcagcacatacatttgaaaagtaagtgcgtagtttttctgtcgcgtcatggtcaaaaatctggcgtcggtatctggtgacaaagagcaggtgaacatgcatcaggaaaacacaatgccttccacgccggatatcggtttcttttttcacagaccaaagtatcatttgacctgtgaaacgattacaggcatttaaattccagttaagacccggtggtcaacaggagtgtgaaatgaggcgcttcgcaggcgcatgtcgtttcgttttcaatcgtgctctggcacgtcagaatgagaatcatgaggccggtaataaatacatcccttacgggaaaatggcttcctggctggttgagtggaaaaatgccactgaaacgcaatggcttaaagattctccctcacagccattgcaacagtcactgaaagaccttgagcgggcttacaaaaacttcttccggaagcgggctgcttttccccgattcaaaaagcggggacagaatgatgcattccgctacccgcagggcgttaagctcgatcaggaaaacagccgtatttttctgccgaaactgggctggatgcgctaccggaacagccgtcaggtcacgggtgttgtgaaaaatgtcactgtcagccagtcctgcggtaagtggtacatcagtattcagacagaaagtgaagtatcaactccggttcacccttcagcatcaatggtcgggctggatgctggcgtggctaaactcgccacgctgtcagatggcacagtctttgagcctgtaaacagttttcagaaaaaccagaagaagctggcgagacttcagcgacagttaagccgcaaggtcaaattcagcaacaactggcaaaagcagaaacgcaaaatacagcgactgcattcctgtatcgcaaatatccgcagggactaccttcacaaagtcacaacggccgtcagcaaaaaccacgcaatgatagtcattgaggatttgaaggtcagcaacatgtcaaagtcagcagcgggtacggtcagccagccggggcgcaatgtccgggcaaaatcaggtttaaaccgttcgatactggatcagggctggtatgaaatgcgccgccagcttgcgtataagcagctctggcgtggcggtcaggtgcttgctgttccgccagcgtatacaagccagcgttgcgcgtactgtggtcatacagcgaaagagaaccgcctgtcacaaagtaaattcagatgccaggtatgtggatatacagcgaacgccgatgtaaatggcgctcgcaacattttagcggcggggcacgccgttcttgcctgtggagagatggtgcagtcaggccgcccgttgaagcaggaacccaccgaaatgattcaggcgacagcctgaacgtagcagggatccacgtccttcagggcgtggaggatgtcaatatcggtttctgtcagcgattaaattcaacaccacgtaacaaacgcctccggcaattaatccccaaaacgcagaaccaatcccgaccagcgtcaatccacttgccgttaccagaaatgccaccaccgccgcgtctcgctcacgctcattatgcagcgcctgatacaaactgccgccgatggtacttaacagcgccagacctgccagcatctggatccaacttacgggcagggcagccatcatcccggtaatggcactaccaaacagacctgcgagcaaatagaaaatgcctgcaacggcagcggccagccaacgttgatctttatccggatgcgcttccgggctttggcaaatagccgcggtgattgccgcaataccgacggaataaacgccgaaaggggaaaaaaccagtgccagcaatccagtaaatacaattaatggcgaaacaggagccgaatatccagctgctttcattgctgcgatacccggtgcgttttgcgatgccatcgtcaccagaaaaagggggagtgcaacgctcaggctgtgagcaaacgaaaaatcaggggtaatataagtggggagaacgggtttaaagacaacatcagttgtgacaacgtcaccttgcgcgatgacgatcacgatcccaataatcatcgcggcaattaccgcatagcgcggcgcaacggccttggttgccagccataccagcaacatacttccacacaacgtaaattgaccgtccagactggcaaacgcctgtaaaccaaagcgtaataaaatcccggcaagcattgccgccgcaagcgagtgcggaataatgcgcatcagacgagcaaagagtcccgttatgccgcagaggactattagcgcgttggtgacaataaaaacgccgatggcttcgttaagtgttagtccctgcaatccggtgaccaacaaagccgcgccaggcgttgaccatgcggtgagaacaggtacgcgataccataatgtcagagtcagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttatagcgtacaggcaccgtagcatttgtccgttataacgcacaagtgataaacttccgttttgccggaggagtcgcatggaaaatctcgctcgctttttatccaccacacttaaacaactacgccagcagcgcggctggagtctttcgcgactggcagaagcgacgggcgtttctaaagcaatgttagggcagattgagcgtaatgagtccagtccgacggtcgcgacattatggaaaattgccaccgggttgaacgtaccattttcaacatttatttctccgccgcagtccgctacgccttcagtttatgatccacaacagcaggcgatggtgatcacttcgctgtttccttatgatccacaactctgctttgaacacttctcgattcagatggcatctggtgcaataagcgaatcgacgccccatgagaagggggtaatcgaacatgtcgtcgtcattgatggacaacttgatctgtgcgttgatggggaatggcagacccttaattgtggggaaggcgttcgatttgctgcagacgtcacgcatatctatcgtaatggtggggagcaaaccgtacattttcattccctcatccattacccgcgcagttaagcgggaaaactatttcgcaacgtcgcgcttgtggctaaaatagccgccatttttcagctactggataagaatgtgaccgtatcttctcatcgacttgaactgttaagcccggcacgcgatgccgccattgcccgcgaagctattttgcacggtgccgatgctgtttatatcggcggccctggttttggtgcccgtcataatgccagtaatagcttgaaagatattgccgagctggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgacattcgtacagttgaaaaagcgaagttcctctctgatgttggcttcacgcagattgtgctggcgcgagagctgaatcttgatcagatccgcgcgattcaccaggctacggacgcgaccattgaattctttattcatggggcactgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggtgtacgctccttcaagattgaagggcgttacaaagatatgagctacgtgaagaatatcaccgcccattatcgccagatgcttgatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtaggcgaagtagtgaaagtggcgaaagatcatctcgatgttgccgttaccgagccactggcaaatggcgatggcctgaacgtgttgattaaacgtgaagtcgtcggttttcgtgccaatacggtcgagaaaaccggagaaaatcagtaccgcgtctggcccaatgaaatgccagcagatttgcacaaaattcgtccacatcacccactaaaccgtaatcttgatcataactggcagcaggcactgacaaaaacctccagcgaacgtcgggtggcggtagacattgaactgggcggctggcaggaacaactgattctgaccctcaccagtgaagagggtgtcagcatcacgcatacgctggacgggcagttcgacgaagccaataacgccgaaaaagcaatgaacaatctgaaggatggtctggcaaaactggggcaaaccctctattacgcccgcgatgtgcaaattaatttgccgggggcgctgtttgtaccaaacagtctgttaaaccagttccgccgtgaagctgctgacatgctggatgctgcgcgtcttgccagttaccagcgcggcagccgtaaaccggttgctgatcctgcgccggtttatccgcaaacgcatctgagtttcctcgcgaacgtatacaaccagaaagcgcgtgaattttatcatcgctatggtgtgcagctgattgacgcggcgtatgaagcacatgaagagaagggcgaagtcccggtgatgatcaccaagcattgtctgcgctttgcctttaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgagctgctgaaaacattgccgaagcgaaaagggtaaaacgccagttttctggttactcacaacttattgaatctgcatgatattgcctgccgggtaaggcgttacgccgcatccggcatcaaatgactcaacgttgtcccgcttctggtttgcgcgatttttgccagtaaaaatgctcgcgcaaaccttccgccgactcttccgccacagcacgcaattcatcgctgtccgcttcatgacgcagctgatgatccacattctttacccacacaaattcatgtcctttgtgccctgccatgagttgtcctgaaaacagagcacacgttaataagacaaccgataacgccttcgtaaacatcctgccacctttttcttaccttttgccgctatgatgccgatcgtttcttgaggttattattcagttttgcaaattagcgcaaagaaattctggaatcttccttcctgattttgcattgcattctgccgttgcggcgatttagtgctattttcgagcaaattacacacggaggtaaacactaatgtttactttgttgatatactcagcggcagggaggcgatgtgaaacaaagcgagttcagacgttggctcgaatctcagggcgtcgatgtagcgaatggcagcaaccatttgaaactcaggtttcatgggaggcgcagtgtcatgccgcgtcacccctgcgatgagattaaagaaccattgcgtaaagcaatcctgaaacaactcggtttgagttaatcgccaattaaaaaggttaatgacatgcgagagacagtcgaaattatgcgttatcccgtcactcttacacccgcgccggaaggcggttatatggtttcttttgtggatatccctgaagcgttgacccagggcgaaactgtcgctgaagcgatggaagcggcaaaagatgctttactgaccgcatttgatttttattttgaagataacgagcttatccctttaccttcgccattaaatagtcacgatcactttattgaagtacctttgagcgtcgcctctaaggtattgctgttaaatgcttttttacagtcagaaatcactcagcaagagttagccaggcgaattggcaaacctaaacaggagattactcgcctatttaacttgcatcatgcgacaaaaatcgacgccgtccagctcgcggcaaaggcgcttggcaaagagttatcgctggtgatggtttaattacagttaacgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttcaggcatgagctttatgactgtcagccatgcctatcagttgctcgaaagtcagggatatattatcgcacgaccgcagtcgggttattacgttgcgccacaggcaataaaaatgccgaaagcgccagtcattccagtcactcgagatgaagcagtcgatatcaacacttatatttttgatatgttgcaggccagtcgcgatccgtcggtcgttccgtttgcctcggcctttcccgacccgcgacttttccccctccaacaactaaaccgctcgctggcgcaggtaagcaaaaccgccacagcgatgagcgtgattgaaaacttaccgccaggaaacgcagaactgcgtcaggctattgctcgtcgctatgccttacagggcatcaccatttctcctgatgaaattgtcattactgccggggcgttagaggcattaaacctcagtttgcaagcggtaactgaaccgggcgattgggtgatagtagagaatccttgtttctacggtgcgttgcaggcgctggagcggctacggctgaaggcgttatcggtggcgacggatgttaaagaagggatagatcttcaggcgctggaactggcgttgcaggagtatccggtgaaagcgtgctggctgatgactaatagccagaatccactcggatttaccttaacgccgcaaaaaaaagcacaactggtggcgttgctcaatcagtacaacgtaacgctgattgaagatgacgtttacagcgaactttattttggacgggaaaaaccgctgcctgcgaaagcgtgggatcgccacgatggcgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcaacttgcgctggtggattacctttccacgcgccgatacgacgcccatcttcgtcgcctgcgtcgccagcttgcggaacgtaaacaacgtgcctggcaggcactgctgcgttatctgcctgcggaagtgaaaattcatcataatgacagtggttactttctctggttggagctccccgagccgttagatgccggcgaattaagcctggcggcactgacgcatcatatcagtattgcgccgggtaaaatgttttctaccggtgaaaactggtcacgttttttccgttttaataccgcgtggcagtggggagagcgtgaagaacaggcggtaaaacaattaggcaaacttattcaagaacggctgtaatagcgtttaatttaattcctcttagattgggtaatatgaatttcgaatagcagtcatatttcctaactccttgactatactccagaagataaccttacagacggcataatgcgcggtagctcacaacctgaataaattttctcaggggcgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagataaaccggaagggcgactggatattatcgcctggccgggatacatcgaacgcggacaaactgataaacaatacgactgggtaacgcagttcgaaaaagagacaggctgcgcggtgaatgtgaaaaccgccgcgacttccgatgaaatggtcagtctgatgaccaaagggggttacgatctggttacggcatccggcgatgcctcgctgcgtttgattatgggtaaacgcgtgcagccgattaataccgcattgattcccaactggaaaacgctcgatccgcgcgtggttaaaggcgactggtttaatgttggcggcaaagtttacggcacaccttaccaatgggggccgaacctgctgatgtacaacactaaaaccttcccgacgccgccggatagctggcaagtggtttttgttgagcaaaatctgccggacggcaagagcaataaaggccgcgttcaggcttatgatggccctatctatattgcggacgctgcgttgttcgttaaagccactcagccgcagttgggcatcagcgatccgtatcaactcaccgaagaacagtaccaggcggtgctgaaagtgctgcgcgctcaacacagtttgatccatcgctactggcatgacactaccgtgcaaatgagcgatttcaaaaacgagggtgtggttgcttccagtgcctggccctatcaggccaacgccctgaaagccgaaggccagcctgttgctaccgttttcccgaaggagggtgttaccggttgggctgataccaccatgctgcatagcgaagcgaaacatccggtttgcgcctacaaatggatgaactggtcattaacgccaaaagtgcagggcgatgtggcggcctggtttggctcgttaccggtagtgccggaagggtgtaaagccagtccgttattaggcgaaaaaggttgtgaaaccaacggttttaactatttcgacaaaatcgccttctggaaaacgcctatagcagaagggggcaagtttgttccctacagtcgctggacgcaggattacattgccattatgggcggtcgctaacttcgctggggtgctttatgacgtacgcagtggagtttgacaacgtctcgcggttgtacggtgacgtgcgcgcagtagatggcgtcagtattgcgataaaagatggtgagttcttctctatgctggggccgtccggctccggcaaaaccacctgcctgcgcctgattgctggcttcgaacagctttccggcggggctatctctatctttggtaaacccgccagcaatctgccaccgtgggagcgggacgtgaatactgtctttcaggactacgcgctatttccgcatatgtcgattcttgacaatgtcgcctatgggctgatggtcaaaggcgtgaataaaaagcagcggcacgcaatggcgcaagaggcgctggagaaagtggcgttggggtttgtacatcaacgtaaaccgtcacaactttctggtggtcagcgccagcgggttgctatcgccagagcattggtgaatgaaccgcgcgtattgctgttggatgaaccgctcggcgcactggatctcaaattgcgtgagcagatgcagctggaactgaaaaaactgcaacagtctctcggtatcacttttatcttcgttacccacgatcagggcgaagcgttatcgatgtccgatcgtgtggcggttttcaataatggacgcattgagcaggtcgattccccgcgcgatctctatatgcgcccgcgcacgccgtttgttgccgggttcgttggtacatcgaatgtttttgatggactgatggcagagaaactttgtggcatgacgggaagcttcgccctgcgaccggaacatatccgcctcaacacccctggtgaactgcaggccaatggcacgatccaggcggtgcaatatcagggcgcggcaactcgttttgaactgaaattgaacggcggtgaaaaactgcttgtgagtcaggccaatatgacaggcgaagaactgcctgccacgctcacgcccggacaacaggtgatggtttcctggtcgcgtgatgtgatggtgccgctggttgaggagaggtgaatggcgatgaatgtattgcaatcaccttcacgtccaggtctgggtaaggtgtccggtttcttctggcataatccggggctggggctgtttttactgctgcttggcccgctaatgtggtttggcattgtctatttcggctcgctgctgacactgttatggcagggattttatacttttgacgatttcaccatgtcggtaacgccggaactgacgctggcgaatatccgtgcgctgtttaatccggcgaattacgacatcattctccgcacgctgactatggctgtggcagtcactatcgccagcgccattctggcttttccaatggcgtggtatatggcgcgctataccagcgggaaaatgaaagcgtttttttatattgcggtaatgttgccgatgtgggcgagctacattgttaaagcctatgcctggacgttattgctggcaaaagatggcgtggctcagtggtttttacaacatcttgggctggaaccactgctgactgcgttccttacattacctgcggtgggcggaaatacgctgtcaacttccgggctggggcgctttctggtgtttctctatatctggttgccgttcatgatcctgcccgttcaggcggcgcttgagcgtttgccgccgtcattgttgcaggcgtcggctgatctcggcgcacgtccacgacaaacctttcgctatgtggtgctgccgctggcaatcccgggtattgccgctggctctatctttaccttctcactcacactgggcgattttatcgtcccgcagctggttggtcctccaggatattttatcggcaatatggtttattcccagcagggggcgattggcaatatgccgatggcggcggcattcaccctggtgccgattattctcatcgcactgtacctggcgttcgtgaaacgtctgggagcgttcgatgcactctgaacgcgcaccgtttttcctcaaactggcggcctggggcggcgttgttttcctacattttcccatcctgataatcgccgcctatgcgtttaacactgaagatgcggcgtttagttttccaccgcagggcctgacgctgcgctggtttagcgtggcagcacagcgtagtgatattcttgatgccgtgacactgtcacttaaagtggcggcgctggcgacattaattgcgctggtgttagggacgctggcagctgccgcgctgtggcgacgagactttttcggcaaaaacgccatttcgctgttactgctgctgcccattgcgctgccgggcattgtcactggtctggcgttattaaccgcctttaaaaccatcaatctggagccgggatttttcaccatcgtggtcggtcatgcgactttttgtgtagttgtggtgtttaacaatgtcatcgcccgttttcgccgcacctcctggagtctggttgaggcgtcaatggatcttggggccaatggctggcaaaccttccgctacgtagtgttgccgaatctcagttcggcgttactggcaggaggaatgctggcgtttgccttgtcgttcgatgaaatcatcgttacgacctttacggcaggtcatgaacgaacgttaccgttgtggttgctcaatcagcttgggcgaccgcgtgatgtaccggtaactaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggaaattgccgaggcatccgcagagcaggtcgatgctgctgtgcgcgcggcagatgcagcatttgccgaatgggggcaaaccacgccgaaagtgcgtgcggaatgtctgctgaaactggctgatgttatcgaagaaaatggtcaggtttttgccgaactggagtcccgtaattgtggcaaaccgctgcatagtgcgttcaatgatgaaatcccggcgattgtcgatgtttttcgctttttcgcgggtgcggcgcgctgtctgaatggtctggcggcaggtgaatatcttgaaggtcatacttcgatgatccgtcgcgatccgttgggggtcgtggcttctatcgcaccgtggaattatccgctgatgatggccgcgtggaaacttgctccggcgctggcggcagggaactgcgtagtgcttaaaccatcagaaattaccccgctgaccgcgttgaagttggcagagctggcgaaagatatcttcccggcaggcgtgattaacatactgtttggcagaggcaaaacggtgggtgatccgctgaccggtcatcccaaagtgcggatggtgtcgctgacgggctctatcgccaccggcgagcacatcatcagccataccgcgtcgtccattaagcgtactcatatggaacttggtggcaaagcgccagtgattgtttttgatgatgcggatattgaagcagtggtcgaaggtgtacgtacatttggctattacaatgctggacaggattgtactgcggcttgtcggatctacgcgcaaaaaggcatttacgatacgctggtggaaaaactgggtgctgcggtggcaacgttaaaatctggtgcgccagatgacgagtctacggagcttggacctttaagctcgctggcgcatctcgaacgcgtcggcaaggcagtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccagtagtgagtgttacgcccttcgacaacgaagaacaggtggtgaactgggcgaatgacagccagtacggacttgcatcttcggtatggacgaaagatgtgggcagggcgcatcgcgtcagcgcacggctgcaatatggttgtacctgggtcaatacccatttcatgctggtaagtgaaatgccgcacggtgggcagaaactttctggttacggcaaggatatgtcactttatgggctggaggattacaccgtcgtccgccacgtcatggttaaacattaaggataatattgcagatcgtaagagtatgagatgatcttgcgtactgtcagagcactgatttctctgacagtacgtgctgcgtgcaaaatcactacatcaaataaaccagccaaatctcatagagataagagtaaacaaaccaacagcagcaaagaaatttatcagtactacagttctactggaaacattcatttttgccaccttttatcattgcccctatgtgtatagtacgggttaagaaaatccgcaataatactcattctgaagatggataagggcaagttgctgtttgatgattttttctcaaactggtgaaaaaacttgatgcacgtcaaaaaatgacgcatatttgcgcgcgttttattcatctggctggacgcccgtacatgtctctctatcaacacatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttcactgttttaaatcttactcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcaacgtctgcgcacagcgatcgcccatcacggtcgcaagcataaagaagatatggaagcgcgccacgaacagttaaccaaaggcggcaccatcctctgattaaaatgagcgtctggctaccaaccaggcgccaaccacaagtaaaattgcgccacaaattgggccgaacaacgcccgtagtggtacgccatgactgcggaagatatccagcatcagaccgccaatcagctgactggcgaccagtacagcaatagttgtcgccgctcccacattctgatatccgctgatactggcgaagacaaaaaacgatcccagcaagccaggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggacaaccagaccaattccggcggcaatcaaaaaagcaagggtgagcgactgattcatccaatcgcgtccggttcagtgcgctcgtcgagttgcaactgcataaatgtcagatccagccaacgaccaaatttagtgcctacctgcggcatttgcgcggtgacgacaaatcccagcgactggtggagatgcagcgaggcctgattttgcgattcgatcccggcgaccatgacatgcttcccgcaatcccgcgcttcatcaatcaatcggcttaacaatttacgccccagacctttgccctgatgatcgggatggacataaaccgaatgttccacggtatggcgaaaaccatcgaaactacgccagtcgccaaacgaggcatatcccgtcactacgccgttttcctcgctcaccagcactggataacctgctaaagtccgcgcttcaaaccaggcaatgcggttatcagcatccaccgtttggtcattccagatagccgccgtatacaacacggcgtggttataaatttccgcaatggcagcacagtcggctttgcgggcaaaacggatggacatgtctggcctcaataaaataatgatgatgatgttatcaatactatcgaaaacagcccgaagcaacggattcctcgatgaaattattgcgtgttgcagaggggatgtgacggctgcaaacaaaaccaatcccgtgagcctgctactattgatggattcatgccaaaagcacaggagagcattatggggcaacaaaagcagcgtaatcgacgttgggttctggcctcgcgtccacatggcgcacctgttccggagaatttccgtcttgaagaagatgatgtcgccacaccgggtgaaggacaggtgttactgcgcacagtttatttgtccctggacccgtatatgcgtggacgtatgagcgatgagccatcttattcaccgcctgttgatattggcggcgtgatggtcggcggtacggtgagccgtgtcgtggagtcgaatcatcctgattatcagtctggcgactgggtgctgggctacagtggatggcaagactatgacatatccagtggtgatgatctggtgaaacttggcgatcatccgcaaaatccatcgtggtcgctgggtgtgctagggatgccaggctttaccgcttatatgggcctactggatatcggtcagcctaaagagggcgaaacgttggtggtagctgcggcgacaggaccagtgggggcgacggtggggcaaatcggcaaacttaaaggttgcagagtggtgggggtagccggtggcgcggaaaaatgccgccatgctaccgaggtgttaggcttcgatgtttgtcttgatcaccacgcggatgattttgccgaacaactggcgaaagcgtgcccaaaaggtattgatatctattatgaaaacgtgggcggtaaggtattcgatgcggtgctaccgttacttaatacatctgcgcgcattcccgtctgcggattagtgagcagctataacgctacagagctaccacccggtccggatcgtttacctctgttgatggctacagtgctgaaaaaacgtattcgcttgcaaggttttattatcgctcaggattatggtcaccgcatccatgagtttcagagggagatggggcaatgggtgaaagaggataaaatccactaccgcgaagaaattactgacggtttagagaatgcgccacagacgtttatcggcctgctgaagggtaaaaacttcggcaaagtggtgatccgcgtggcgggtgatgattaaagtttcaacggcggcgtaagccgccataaaaatccaggcaaaaagcttattttcagctttaattaactaaccacatcattgttctgctgctaataacaacaaaggtgagtggtttatgattattcactttaatacaccaggtgaattccttctgccatgcaggcagggttggacagaaaacacgcgaaggaattaaaatgcctggaacgggaaaaatgaaacatgtcagtttgactctgcaggttgagaacgacctgaaacatcagcttagtattggcgcattaaaacctggcgcacgcctgattactaaaaatctggcggagcaattaggtatgagtattacacctgtgcgtgaagcattattacgtctggtttcggtgaatgcgctttctgtcgcacctgcacaagcatttacagttccggaagtggggaaacgtcaattagacgaaatcaatcggatccgctacgaactggaattaatggcagttgctctggctgttgaaaacctcaccccgcaagaccttgcggaactccaggaattgctcgagaaattacagcaggcgcaagaaaagggcgacatggaacaaatcattaatgtaaacaggctatttcgcttagcgatttatcatcgctcaaatatgcccatcctgtgtgagatgattgagcaactgtgggtcaggatggggcctggtttacattatctctatgaagcgattaatccagcggaattacgggagcatatagaaaactatcatctgttactcgctgcgttaaaagcaaaagacaaagagggatgcagacattgtcttgctgaaattatgcaacaaaatattgctattttataccagcaatacaatcgttaaagtaaatgcccggcaaataccgggcatcaaggtaattactcaaatctccacgcaatattcatgccgacaccataatttcgtccgggcgaaggttcgtaatatcgcccgtttgactcattgacaatgacagaaccaacgtattctttatcgaataaattatcgacacgaccaaataaatccacagttaaattgtggtaattgtatttatacccggtgaataagccgacgagagtataagacggcgcttttgccgtattttcatcatctgccataatatcgcccatataacgcgcttccgtgcctgcataccaaccatcttccggtacataacctatcgacgcaaagcccatattacgggcgatccctggcatccgattaccgttacaatcctgttcattgcaaacattgctgcgataggtcgcatcaagccaggtccaggacgcgtttacgcgaaaatctcctgcgaaacgttgatcccatgccagttcagcgccttgacgacgggtctttccggcatttttgtaagtcgtacgcccaccgctactgctatcgacaacaatttcatcatcagtgtcggtctgaaacaatgcgagactaagcagcccatcaccaatacgcgttttactgccgatctcaattgtatcgttggtggatggttttaaacctaagttcataccgctttgcccatcagcacgataagacagctcattaatcgtcggcgtttcaaaacctcgcccggctgccagatagatattccaggcatcggtcattgcatattttaacgaaccggcaggtagccatttatgataactggcatcaccgctgtcatcgccgttacccggagtaacgtaatggtcgttggaatcaaaccacacggagctgtagcgcacgccagcatccagcgacagtttttcgctcagctgccactgcgtctgtaaatagggatcgatgttccacatcagattgcgttcgtcgcgacgcaactcacctttttgcccgtactccggcatgccgctattcaggcggaagttattgtagcccttgcggttttcactcatgttttcgtagttcaggccggtagtgaacgtgaccggaacgcccagttcaccacggtgtgtccagcggctgtctattccctggtaatggcgttgcagggtaatcacgccgcccgcatgtgacgggttaagttgtggtgccatgggtattgactggtactgggtcgtttctcgctctccggcatacatcatcacactcatatcatcccgcgaactcaggctacgctcatagcgcaacccagcctgagtttgcttgatggtttttcgcgtgtcgtactgttctgcacgaggcgcttgttgtggattagccttccattctgctttggttagcccacctgggtcatctgctttgatatccacactattgaaaatcagacttaatttgctggcttcatcaatgcgtacgcccagtttggcattggctaaatttttctgtgcgccactatggtcacgatagccgtgggtcgtaaaacgcgtggttgagacggtgtaatcgacatcgccaggctgtgtgccgtctcccgttgcgcccgttgctttcagcccatagcgccagctgccaaaactgccgtagtaactactggcttcaatggttggtggctgttgtccggtctgggtggtgacattcattaccccaccagacgcgttgccatacagggcagagaaggggccacgcagcacttccacattttgcacactgcttaaatcgatgttggatgtttgcccttgcccgtcgggcatggtggcgggaataccgtccacatacaggcgaataccgcgaataccgtaagtggagcgggagccaaatccgcgaatcgacagctgtaaatcttgcgcatagttctgccggttttgtacctgcaaaccaggcacgccggtcagtgattcggacaagttaatgcgcggtgttgccaggcgcatctcctcgccatccaccacgcttactgctgctggggtatccagttctgaaaccacctgcggtgcggcactgacaatcatagtctgttcatcagcggcaaaaacaacgggggaaaggacaagcagtgcgggcaaaacggtctgtcggacggaaaaaatcttcatgaaaaaagccaggttaagaatgggaaaacgccgtcatggtaatgaaattgtaaatttatggaaaatgaaacggcacaatacgttaagtaattgagaaaattgtagtcgtaacggcaagaaatgctccacatttgagaaaataatgattaccattcccatttataacaagagcgtaacgatgattacgcttagcgaagcattgtgaagcagcaaaaatatcggttcatcaaagggagtcgtcatgcatttacgtcatctgttttcatcgcgcctgcgtggttcattactgttaggttcattgcttgttgtttcatcattcagtacgcaggccgcagaagaaatgctgcgtaaagcggtaggtaaaggtgcctacgaaatggcttatagccagcaagaaaacgcgctgtggctcgccacttcgcaaagccgcaaactggataaaggtggcgtggtttatcgtcttgatccggtcactctggaagtgacgcaggcgatccataacgatctcaagccgtttggtgccaccatcaataacacgactcagacgttgtggtttggtaacaccgtaaacagcgcggtcacggcgatagatgccaaaacgggcgaagtgaaaggccgtctggtgctggatgatcgtaagcgcacggaagaggtgcgcccgctgcaaccgcgtgagctggtagctgacgatgccacgaacaccgtttacatcagtggtattggtaaagagagcgtgatttgggtcgttgatggcgggaatatcaaactgaaaaccgccatccagaacaccggtaaaatgagtaccggtctggcgctggatagcgaaggcaaacgtctttacaccactaacgctgacggcgaattgattaccatcgacaccgccgacaataaaatcctcagccgtaaaaagctgctggatgacggcaaagagcacttctttatcaacattagccttgataccgccaggcagcgtgcatttatcaccgattctaaagccgcagaagtgttagtggtcgatacccgtaatggcaatattctggcgaaggttgcggcaccggaatcactggctgtgctgtttaaccccgcgcgtaatgaagcctacgtaacgcatcgtcaggcaggtaaagtcagtgtgattgacgcgaaaagctataaagtggtgaaaacgttcgatacgccgactcatccaaacagcctggcgctgtctgccgatggcaaaacgctgtatgtcagtgtgaaacaaaaatccactaaacagcaggaagctacccagccagacgatgtgattcgtattgcgctgtaatagatatggcgagggtgaaaacggtgagacttgcctgccttttatcacggcgtatccggcactttcgtcagtaatctgaatttgcccggcacgtagccgggcaattttgcaattaactcgccgtttcaggcttaaacacaatttcctgtttttcttcatcttcctcgacgactggcgcagtgctgtgaatttcagcaacgcgtttgcgcacaccaaaccagcctataaccagcaaaataccgataatcggcagcgccgcgatagtataagtcccgttcgggtaatcgaacgccatcagcacaaggacactcagtaaaaacagtaatgtcagccaggaagtgaagggcgcgccaggcagtttaaaactgacatccgctgctttgccttctttaatcgctttacgcaggcgcatctggcacacgatgataaacgcccatgaagcgatgattcccagcgacgcgaagttcaacacaatctcaaatacgcgcgacggcaccagatagttgaggaatacgccgacgacatacacaactagtgtcgccagaatcccggcatacggcacatgctgacgactcattttcgccataaaactcggtgcggaaccgcccatcgccattgagcgcagaatacgtccggtgcagtacagacctgaattcaggctggagagggcagcggtcagcaccacaatgttcataatgctgccgatatatggcacacccagtttagagaaaaacgtcacgaacggactttgccccgcctgatacgcgctccacggcaataacataaccagcaacaccacggagccgacgtaaaacaggccaatacgccaaatcacactgttaatggctttaggcaccatggtctgcggatctttacattctccggcagctgtacccaccatttcaatggaggcaaaagcaaacactacgccctgaatcaacaccagcgcaggcagcaaaccgtgggggaagaagccgccattatcggtgattaaatgaaagccagtggtgttgccatccagcggctgaccactaccgaggaacactgtacccacgaccaaaaaggtcacaatggcgagcactttaataagcgcaaaccagaactccatctccgcaaaccatttcacaccgatcatattcatggtgccaacgatggtaagtgcagcgagcgcaaagacccactgcggcacgccgccaaacgcaccccagtaatgcatatacagagcgacggcggtaatatcaacaatccccgtcatcgcccagttgatgaagtacatccagccagcaacataagcggctttctcacccaaaaactcacgggcataagaaacaaaactgccactggaagggcggtgtagcaccagctcacccaatgcacgcagaataaaaaacgaaaacaagccacaaattaaataaaccagtgccagtgcgggccccgccatttgcagtcgggctcctgcacctaaaaacaagccggtgccaatcgcgccgccaatggcgatcatctgcacctggcgattgcccatcgctttgtgatacccctcttcgtgggcattaagccagcggcgtttcgcggcgtgttgatctgaagtgtcggtgtcgtgtttactcattgctctccctgattgctttaatgaaaaagtcatataagttgccatgaacaatgtttattcatcctggcgatgatagttatcaccattattctttatgggtataaaactatcggcgcagcatcctacccgttatcgataaacgatgcaaaacatccccttacaatcctgaaggggattaatacaactgacgaaaaaatgacaaatccttttgctggttaacctgtgtactgtcctacacttaatctttaaaagattgtgaggggcatatgattaaggtgtatggcgtacccggatggggctctacaatcagtgagctgatgctaacactggctgatattccttatcagttcgttgatgtcagtggttttgaccacgagggagcttcacgcgagttattgaaaaccctgaacccgttgtgtcaggttccgacactggcattggaaaatgacgagattatgacggagacagcggcgattgcattgatggttctcgatcgtcgcccggaccttgcgccaccggttgggcgcgccgaacgtcagctgtttcaacggctattggtctggctggttgctaatgtctatccaacattcactttcgccgattaccctgagcgttgggctcctgacgcacctgaacagttaaagaagaatgttattgaatatcgaaaatcgctttatatctggttgaattcgcagctcactgctgaaccttatgcgtttggtgagcaactaacgctggtggactgttatctttgcactatgcgcacatgggggcctgggcatgaatggtttcaggataatgccacgaatatcagtgcgattgctgatgctgtatgtcagttaccgaaattacaagaagtattaaaaaggaatgaaattatttgagtgggataccagaagattatgttatttattattcagtaactttatccacaatgatgggcgtaattaattaaattcatggtatgttttttaatttatatcactctccttttcattcagcgtgtctatttcatttcctctgaaaagaaactaactattcacatcgtgcagatgtttcagttgttatcacaggcattctataatctcaaaatgtttttaatgatggatatgctcggagttggagatgcaattaatattaatacaaataaaaatatccggcaggtatgctaaaaggataaatggcgttctctgtatttattcgcaattatctgtaggacaaatatggagagcttgatgagtcagagctaaaacagcaattgattaataaacatgttgatttattcaagaaaatggatgtattttaaatgttgattcttaatataacctaatcaatagattatcaagtgagagctacacattattggaggggcaggggaaaacaccattttgggaacaatgcatcaggtactcttaccactgaagcaagatcatccggcaccaggtggtggtgcagtgctttggaaatggtcccctcgggggagttgtcattattttctatgctatttgcttattatattcatcaggtgaatttaataaattcctaatttgaaatatccactattaagctagtgtttaacgacgttaagatggcaatgtgcagatcatgttatcagggtggggcggtagcgtatattccttatacaaaccatcattcatttcaatgattgttattgaattatttattgttgtgaataaaaagacattatgaatattggtttgactttgcatatcaggttttttattactcgctgtaatgtacgagcctgtcgtgaataacgtcgagaacccatccgttgcgtttgtgattattttgttgactaaacagacacccgtttctctgaagtaaaatcccagactaaatcatcacataaccatgacatttttctgatattccccggtaacgccagatgtcgactcgcttaaccaccctcagccataccagtgaaggccaccgcgtgtcggtccactacggctatgacgataaaggccgcctgaccggcgaacgccagacggtggagaacccggagacgggggaactgctgtggcaccatgagaccggacatgcgtacaacgaacaggggctggcaaaccgcgtcacgccggacagtctgccgccggtggagtggctgacctacggcagcggctatcttgcgggcatgaagctgggcgggacgccgctgctggagttcacgcgcgaccgcctgcaccgtgagacggtgcgcagcttcggcagcatggcaggcagtaatgccgcatataaactgaccagcacatacacccccgcaggccagttacagagccagcacctgaacagcctggtgtatgaccgtgactacgggtggaatgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagttcatttttaccactgcgaccaccggggcctgccgctggcgctcatcagcgaagacggcaatacggcgtggcgcggggagtatgatgaatggggcaaccagcttaatgaggagaacccgcatcacctgcaccagccgtaccgtctgccagggcagcagcatgatgaggagtcggggctgtactataaccgtcaccggcactacgatccgttgcaggggcggtatatcaccccggacccgattgggttgagaggtggatggaatatgtatcagtatccgttgaatcccatacaagtgatagacccaatggggttagatgcgattgagaatatgacatcaggtggactaatttatgccgtatctggtgtacctggattgattgctgcaaacagcattactaacagtgcttaccagttcggttatgatatggatgctattgttggcggagctcataatggggccgccgatgcaatgagacattgttacttgatgtgtcgaatgactaagacatttggatcaacaatagctgacgtgataggtaaaaatcatgaggcggcaggggatagacaaggtcagccagctaaagaaagaatcatggatcttaaaaataacactgtcggtattgcttgtggcgatttttctgccaaatgtagcgatgcatgtattgaaaaatataacactgggcaactcttcgggttagatggtataaaagcagataatccaataaaagcaaagcaagggagttcagatgcttcaaattattagaggcaaacttgtcatttttttaattaccctttgtttatttgttgtttaccttgggtttgataacaattcaaattctgacatcgtattttatggacataaaacaccaaagagcgttgagatatatctttctgaaaaaaatattatttataaaataattaatgaccaaaaaattagtagagggaatggtcattttataagtataatggttaataattacaggacgcactgtggagtggttgatataaatcttaattttttcaatgatattctttatagcgtgcgattaaaaaacattagtaaactggagaatatggagttctgcgctacaaaacaacgggtgtattttagtgataaaaacaagaaggctagttataaaataattaattatggagactattatgatgttgattattatgataacaatttgaaaaatgaagtttttgactggattggtaaatggtcataatgaacaacaccagaaagagaaaaatataaaatacatacagaaagacatgagagcaagggacggggcagggcaagatcatgaaaattgtgatgtaaatcacgattttcatctttgctttaacgcctacaggtgatcaaaatttaacctttggaataactaaaaagataaaaaaggacgccaggtgagtattcaaagtttgcttgattatatttcagtgacccctgatatacgacaacaaggaaaggttaaacataaattatctgctattttgtttctcaccgtatgtgcagtaattgcaggtgccgatgagtggcaggaaattgaagattttggacatgaaagacttgaatggctaaagaaatatggtgattttgataatggcattccggtcgatgacaccattgcacgcgttgtgagtaacattgacagtttggcctttgaaaagatgtttattgaatggatgcaggagtgccatgaaatcactgatggtgaaattatagcaatagatggaaagaccataagaggctcctttgataagggaaaaagaaaaggagcaatccatatggtgagtgcattctcgaacgaaaatggtgttgtactggggcaggtgaaaacggaagccaaaagtaatgagattacagccattccagagttgcttaacctactgtatttaaagaaaaatttgataaccattgatgctatgggctgtcagaaagatatcgcttcgaagatcaaagataaaaaagcagattatcttctggcagtaaaaggcaatcaggggaaattacatcatgcattcgaggaaaaatttcctgtaaatgtgttttctaattataaaggcgattcgtttagtacgcaggagataagtcatggaagaaaagaaacacgtttgcatattgtcagtaacgtaacgcctgaacttttgtgattttgaattcgaatggaagggattaaaaaagctttgtgtagcattgtcattcaggcagaagaaagaagataaatcagcagaaggtgtaagcatccgatattatatttcatcaaaggatatggatgctaaagaatttgcacatgctatcagagcgcactggctgatcgagcacagtcttcattgggtgttagatgtaaaaatgaatgaagatgccagccggataagaagaggaaacgcagcctaaataatatctggaataaagaagatggcactgaatttattaagagattgcaaagacattaagggtgaagaggaaaagaaagaaggctgcgttaaacacagggaaagatcatcagaagttcactttttgtactaaacaattcgcattttatgtttaaaaattgagatattccttattacctaaagctgttttttattgcttacacatgatcaaatactccttacataattaaggagaacaaaatggaacttaaaaaattgatgggacatatttctattatccccgattacagacaagcctggaaaatggaacataagttatcggatattctactgttgactatttgtgccgttatttctggtgcagaaggctgggaagatatagaggattttggggaaacacatcccgattttttgaagcaatatggtgattttgaaaatggtattcctgttcacgacaccattgccagagttgtatcctgtatcagtcctgcaaaatttcacgagtgctttattaactggatgcgtgactgccattcttcagatgataaagacgtcattgcaattgatggaaaaacgctccggcattcttatgataagagtcgccgcaggggagcgattcatgtcattagtgcgttctcaacaatgcacagtctggtcatcggacagatcaagacggatgagaaatctaatgagattacagctatcccagaacttcttaacatgctggatattaaaggaaaaatcatcacaactgatgcgatgggttgccagaaagatattgcagagaagatacaaaaacagggaggtgattatttattcgcggtaaaaggaaaccaggggcggctaaataaagcctttgaggaaaaatttccgctgaaagaattaaataatccagcgcatgacagttacgcaatgagtgaaaagagtcacggcagagaagaaatccgtcttcatattgtttgcgatgtccctgatgaacttattgatttcacgtttgaatggaaagggctgaagaaattatgcgtggcagtctcctttcggtccataatagcagaacaaaagaaagagctcgaaatgacggtcagatattatatcagttctgctgatttaaccgcagagaagttcgccacagcaatccgaaaccactggcatgtggagaataagctgcactggcgtctggacgtggtaatgaatgaagacgactgcaaaataagaagaggaaatgcagcagaattattttcagggatacggcacattgctattaatattttgacgaatgataaggtattcaaggcagggttaagacgtaagatgcgaaaagcagccatggacagaaactacctggcgtcagtccttacggggagcgggctttcgtaatcttgccctgggcattattgtcgtataaacgctttaccggacacatgacattcacaatgtgtgttaattttactgacatctttcaaaaggagcgtaatcatgccgcacatcgacattaaatgttttccgcgtgaactggacgaacaacaaaaagcagcacttgctgcagatattaccgacgttattattcgtcatctgaacagtaaagacagttcgataagcattgctctacagcagattcaaccagaatcttggcaagctatctgggatgccgaaatcgcgccccaaatggaggctttgataaagaaacctggttatagcatgaatgcttaacccgccgtaacacgcttgccgctggtaacaaacgtcccagcacctaaatgatgcaacgtattgagcttatcatcatcaaactgccagcggccttcgacaaatacccgtgcgtctgccgctgctgatactacttcgccaaacagcgtgtcgtattcttcttgcgcagaagtcgcaggtagcaatcgacactccatccacgccagacatttttcctcgaccagaggcaaaccaaataccgggcctctcacaaccggaatgccatagcaattaaatttatcttcatcacgccccgacacacttcccaccgcccacgtccagttagttgctgcaacgcccgggataacgatgccaaatttaccgttatgttcaatcaactccctggtccatgtcgatttatctaccacaatcgccacgcgtggaggttcaaactccaccggcattgaccaggctgcagccataatgttacgccgctgggattgctcatcgaaactggtgatcaagaccgttgggccatgatttaacagacggctggcatggtgtaattctatggggatgaatcggctcatggtatcgcctcgcgaagaaggtttttttaagcgtagtccgtaacgcaataagtaacgaaattaacgggattggcgatttgcgaacgtgatgcatgtccgcgatcgcacaaaatagccggtgcggcgtctattccaggttataagttgagaaaaccactaagggaaacgcctgatgacgcccattctgaatcactattttgcccgtattaactggtcgggagctgctgcggtcaatattgatacgcttcgtgcattgcacctgaaacacaattgcaccattccgtttgaaaacctcgacgttttgctgccgagggaaatacagcttgataatcaatcgccggaagagaaactggtgatagcccgtcgtggcggttactgttttgagcagaatggcgtgtttgagcgggtgttacgcgagctggggtttaacgttcgcagcttgttagggcgcgtagtgttatcaaatccgccagcattaccgccgcgcacccatcgtttgctgttggtggaactggaagaggaaaaatggattgctgatgtcggtttcggtgggcagacgctaaccgcgccgattcgtttagtttccgatctcgtgcagaccacgccacacggagagtatcggttgttgcaggagggtgatgattgggtgttgcagtttaatcatcatcagcattggcagtcgatgtaccgttttgatctctgcgagcagcaacaaagcgattatgtgatgggcaatttctggtcggcgcactggccgcagtcgcattttcgccatcatttgctgatgtgccgccatttgccggacggcggcaagctgacactgaccaattttcattttacccattatgaaaatgggcacgcggtggagcagcgaaatctaccggatgtggcgtcattatatgctgtgatgcaagaacagtttggtctgggcgtggatgatgcgaaacatggctttaccgtggatgagttagcgctggtgatggcggcgtttgatacgcacccggaggcgggaaaataatttatgtcaggttgccggatgcggcgtaaacgccttatccggcatacattagcccggttgtagacctgacaggcgaagcgcatcagacaacggtttcagagttcaattgcccattcggcatgaaacaaaatcaccgctgtgcctgaaatggtgactttttccggttggttatcacgaattgtcaccgtcacttcaatcataccgtcacgccccaatgcgcgcccctgatggcctttaacacgcaacacgttgccatcgtggggcaatacgttgtgatgtaccaaccatgcacccatcgggccattggcattgccagtcaccggatcttccacaataccaatcgcaggcgagaacatgcgaccatcggtttcgtttttgcctgggcggatctggaacgggaagaaaccattgcagccaatctttttgctgatagcggtcagcgcattaaggtcaggcgaaagggcgtcgatatccacttccggtttcagtgggatcatcacttttgagtgtcctgttgttgccacctgaattggcaagcctggcagaatatcgtcctcagtgagatgaagcgcgttgataatcgccgcacgtgtttcaccttccagcggtggctcaaagcccggcgtaccttgttccagcgaaatacgataatcatcgttgtgcttttcgatagtcacgcgatgttttcctgccagcgatgtttgccagatcgtgcaatttcctaaacctaacaccttcgcacgtacatagtgcgcagctactgtcgcgtgaccgcaaatcggcacttcaaccgttggcgtaaagtagcggatgcgcacatcgctgtcgtcgctgtgcagcagaaaagcagtttccgaatggcctaactcgcgggcgataagctgcatttgcgcttcgctaagattatcggcggggaaaacaacaccggcagaattgccgcgaaacggttgtgaggtaaaagcatcgacgtggtacacctgcggtttcattaacgttctcctgtgactggagaactatcatagcctgcaagtggccggagagcgaagggctatccggccagggtgaaattatcgccgcgaacgcacaatttgatatcgacgagtaaagtactcaaacggcgcgctccacacatgcaccagtcgggtgaacgggaagagcaggaagatggtcattcccaacaccagatgcaggcggaagacgaacgctacgccgttgagcatctctgacgatccaccacggaaagtgacaatgctttgcgcccaacccaccagcttcatcatttcgctaccatcaggatactgtgctgaaaacggtatggtacttagccccaacagacactggatcagcaaaatgctcatgatgatgatatccggcgtagtggaagtggcacgcacgcgctgatttgtcagcctgcgccacagcagtcctgcgccgccaatcaacgtcaacacaccgcaaataccgccgagcaccatcgccatgagttgtttcgctgccactggcaaaaaccacgcgtacatccagtgcggcgttaacatgccgaacaagtgcccgaagaaaatccccaaaatgccgatatggaacagattcgaccatatcaccatcccgcgtttatcgagcatttgacttgaggaggcgcgccaggtgtactgcccgtagtcgtagcgcagccagctgccgaggaaaaacaccgtcgcacaaatgtacgggtagatatcgtaaaaaaagacgttcagatactgaatcatttcccacctcccgcactgatgtcgacatattgcggcgcgacatcctggctaaagcgtcgctgatattgattaagcggcgagctgtcacacgccgtggcgttatcttcaataaacttcacctgttcctcttcccacactgcatcaagcgcctggcgggtgtcatcgcgctcttcgctgtttacttgttttgtgacactgtcacttgaaagggagcttcccgccagttgcagcagagcatcaaacaacgcgtaccacggtgcctcgcgttgttttaagcgaccgccaagcagggcgaggatcggcgcaacattgagcaatccttctttcgcctgatcgtcaggcagtacgcttaaatactccagatacagcggtagataatcgggcagttcccgacaatccagctgcaggccgaccttttcatactccgccagcaggtccaccattgcctggccgcgatcgcgggactcggcatgaacatgttcgaacagcagcagcgacgtggtgcgcccgcggtcaaacacttcgcaccattcggcctgtttatccagcagcggcgcgttaagcaggttgtgggtgaaatccgtaagcatcggcgcgtcgcggcggatcaacgccagcgcgtcctccttgcattcccacaacagctcgtccggatactccatcaacaggccgatcactttgaggatctgcattattcgccctccgctttgtcgcgcacttcggtgatgttgatggcatcgatacggctactgttgaacaggttgaatttactgtccgaaccgtggcaaccgtcgccaaaggtaaaaccgcagccgttgcgttctgcgaaggcatcgcccgccatttcccgatggctggtcgggataacaaaacgatcttcatagttggcaatggcgagatagcgatacatctcttcgacctgggcgacgctcaggcctacttcgtcgatggcacgagtatcagtaacgccttccacggtttgtgaacgcatatagtggcgcatcgccatcatccgtttcagcgcccgcagtaccggaccggtatcgccggcactcaacatattggcgagatattgcaccggaatacgcaggctttcgatggcgggcagcacgccttcgcttttcggcaaaccgcccgcatctgcgtaggactgaatcggtgacagcggaggaacgtaccagaccatcggcagggtgcggtattcagggtgcaacggtagtgccagtttccagtccatcgccattttgtagactggcgaacgctgggcagcgtcaatcacattttgtggaataccttgtttcagggcttcctcgatcactgagggatcgtgtggatcgaggaacacttcgcactggcgttcatagaggtcaacttcgcgctcggtgctcgccgcttcctcgatgcggtcggcgtcgtaaagcagcacgcccagataccggatgcgacccacgcaggtttctgagcacacggtcggttgaccggactcaattcgtgggtaacagaagatgcatttttctgacttgccgcttttccagttgaagtagatttttttgtacggacaaccgcttatgcacaaacgccagccacggcatttatcctgatcaatcagcacaatgccgtcttcttcgcgtttgtagatagcgccgcttgggcaggtcgccacgcagctgggattgaggcagtgttcgcacaggcgcggcaggtacatcatgaaggtgttttcaaactgcccgtacatctccttttgcatggcctcgaagttgcggtcgcgggcacgtttttcgaactcaccgcccagcagttcttcccagtttggcccccagatcactttgtccatccgtttgccgtcaatcagtgaacgcgggcgagcagtaggaatatgtttgccttccggtgcgctatgcaaatgttcgtagtcgaaggtgaaaggttcgtagtaatcatcaatctgcggcaccaccgggttggcgaagattttggttattacgcccatcttgttgcccagacgcgggcgtatcttgccattcacatcacgcacccagccgccttgccactcttcctgatcttcccagtttttcggataaccaatgcccggtttggtttcgacgttgttaaaccatgcgtactccatgccttcgcgcccggtccagacgtttttacaggtcaccgaacaggtatggcagccgatacatttgtcgaggttaagcaccatgccgacttgtgaacggattttcattttttcgcctcctgtacctgatcgcgaccttcatcatccagccagttaacgttcttcatcttgcggatcatgatgaactcatcgcggttcgatccgacggtgccgtagtagttaaagccccaggccagctgcgcgtaaccgccaatcatatgcgttggtttcgggcaaacgcgggtaaccgagttatgaatgccgccgcgcatgccagttacttccgaaccaggaatattcataatgcgttcctgggcgtgatacatcatggtcatgcccggcggtacacgttggctgaccaccgcgcgggcagtcagcgcgccgttggcgttgaatacttccacccagtcgttatcgacaatggtcagttctcgggcatctgtttcgctgatccagacaatcggtccaccgcgagagagcgtcagcattagcaggttttcactgtaggttgagtgaatgccccatttctggtgcggcgtcaggaagttaagtgctttttccgggaagccgtttggcggtatctggcgcatctcactgacgctacgggtgtcgataggcgggcgataagccaccaggctttcaccaaaagcacgcatccacggatgatcctgatagagctgctggcgtcccgacagcgtgcgccacggaattaactcatgaacgttggtgtatcccgcgttataggagacgtgatcgctttccagaccggaccaggtggggctggagataattttacgcggctgcgcctgaatatcgcgaaagcgaatcttctcgtcctctttgtgcagcgccagatgggtatgttcgcgcccggtgatctcgcccagcgcctgccacgctttgactgcaacatgaccgttggtttccggtgccagtgccagaatcacttctgaagcgtcaatggcggtgtcaatcagcggacgcccctgtgccgggccatcacgcttggtgtaattgagtttgccgaggaaatcgatttcatcctgggtattccacgaaatccctttaccgccattgccaagtttgtccatcaatggcccgagcgaggtaaagcgttcatacgtagcagggtagtcgcgctccaccgccacaatattcggcgcggttttgcctggaatcagatcgcattcgcctttgcgccagtcgagcacttcacacggctgtgagagctctgccggagagtcatgcagtaggggttgtaataccacgtcggtttctttgccaagatgacccacgcacacttgcgaaaatgctttggcgatacctttgtagatttcccagtcgctgcgtgattcccacgccggatcgaccgccgcagaaagcggatgaataaacggatgcatatccgaggtgttcatatcgtctttttcgtaccaggtggcggtgggcagaacgatatcggagaacaggcaggtactggacatgcggaagtcgagcgtcaccagcaggtcgagcttgccttcaatcgctgcagtttgccactcgacttcttccggtttgatcccgtcgctggcaccgagttcctcgccctgaatcccgctttcggtccccagcagatacttctgcatatactcgtggcctttgccggaggagccaagcaggttagagcgccagacaaacaaattacgcggatgattgctgctgctatctggttgttcgcaggccatacgtaaatcgcccgatttcagcgcctgggcggtaaattctgtgggggataatccggccttgtcggcttcagctttaatcccgagcgggttacgccccagctgcggcgcagaaggtagccagcccatacgttcggcgcgaacgttgaaatcaatcagatgaccgctgtacttactggcatcggcgagcggtgaaagtaactcctgagcagagactttttcatagcgccattggctggaatgattgtagaaaaacgaggtgctgttcatttggcgcggtggtcggttccagtcgagcgcaaaggccagtggcaaccagccggtttgtgggcgcagtttttcctggccgacatagtgtgcccagccgccaccgctttgcccgacacaaccgcagaagatcagcatattgatcatcccgcggtagttcatgtccatgtgataccagtggttaacacctgcgccgaggataatcatcgagcgcccatgcgttttatgggcggtatcggcaaattcacgggcgatggtttcaatatactggcgcggcacgccggtaatttgctcaccccaggctggggtgtacggtttgatttcagcgtaatctttcgcactgttttcatcttccagcccgcgatcgaggccgtaattcgccagtaccaaatcataaacgctgaccaccggacaggtgttgccatcgactaacgtcaggtttttaacgggcaattggcgcaccagcaccggattgtgttttacgctgcgaaaatgcggattttcaatgccgccaaagtaggggaaggccacgcctgcaacagcgtcatgttgaccgagcagggttaacgacaattcggtttccgtaccggcggcaatggattccagattccatttgcctttttctccccagcggaaaccaatcgaaccgttcggcactaccaattcacctgcggtattaactgctacggttttccactgcggattgttgctttcgcccagtccatccaccaggtcagatgcgcggatcatgcgcccgggaacgtagctaccatcgtcgcgaggctccagcattaccagcatcggcatgtcgctgtagcggcggcagtagttgataaagtagtcgctgggattatcgagatgaaactcttttaaaatcacatggcccattgccatcgccagggcgctatcagtgccttgtttcggtgccagccactggtcgcacaatttggccacttcagagtagtcaggggtaatggcgatggttttagtgcctttgtagcgtacttcggtaaagaagtgggcgtccggcgtacgtgtctgcggtacgttagacccccaggcgatgatgtagctggagttataccagtcggcagattccggtacgtcggtttgctcgccccaggtcatcggcgaggcgggcggcaggtcgcaataccagtcgtagaaacttaaacaggtgccgccaagcagcgacagataacgcgttccggcggcgtaagaaaccatcgacatcgccgggatcggcgagaaaccggcaacgcgatccgggccgtaggttttgatggtccagacgttagcggcggcaatcagctggtttagttcctgccagttggagcggataaacccgccgcgcccacgcacttgtttgtagctcaggcacttttgcggatcgttcataatcgatgcccacgccagtaccggatcgctgtgttgcttgagggcttcgcgccacagttcaatcagtcgtttacgaatgagcgggtatttcaggcggttagcgctgtaaagataccaggagtaacttgcgccacgcgggcagccgcgaggttcatgattgggcaggtcagggcgagtgcgcgggtagtcggtctgttggatttcccaggtcaccagaccatttttaacgtagattttccagctacaggagcctgtacagttaacaccgtgggtggaacgcacgattttgtcgaactgccaacgctggcgatagctgtcctcccagtcgcggttgctatgcatcacctgtccgtgaccatcggcaaaggtttcgcccttttgtttgaagtagcgaaagcgatccaaaagtttactcatgacatgactcctgctccaggaatgaattgggatctgatgccttgtcggatgcgacacggttgtacatcaggcatcgatctcttatttttggctgaacttccgccgaccataaaccagccaggtcagcagcacacaaacgatgtagaagattaaaaacactttcatcgcgccgaccggagagccggtcatattgagcgacatgccaaacgcctgcggaataaaaaagccgcccactgcgccaatggctgagataaagcccagagccgccgccgtttcggtgacggcttctttatgagcttgctcatcactaccgcctttcatctttacccgataaatggttatctggcgaaagatgacggcgatcatctggaaagtagaaccacttcccagacccgcagtcagaaacagccccataaatacggcgtaaaaggcgatgaaattaccggagcctgtgcccggtaaggtaaggaacagcagggcactgaaaatcgccataaaaataaagttgatcaacgtcacccgcacgccgccgaacttatcggaaatagcaccaccaaccgaccgcgcgatggcaccgataaatgggccaaagaacgccaggcgcagaatattcacatccgggaactgggtttttgccagcatggcaaaacccgcagaaaaaccgataaacgaaccgaaggtggcaaggtaaagcaggctcagcagccagagatgcaggcgttgtaagacagggagctggtcggcaattgaggcgcgtgaactggcgatatcattcatccctgaccatgcggcgatcgtggcaatcgccagtagcggtacccaaatccatgcggcattcgccagcgacatcaccgaaccgtcggcctgcggtacgccattgacgccgagaaaggcaaatacaggtacaaaaatgaccagcggtgcaaccagctgcattacacttacacctaagtttcctaatccgccattaatcccaagagcgctcccttgtttggcttttggaaagaagaaactgatattgcccatgctcgaagcaaagtttgcacctgcaaaaccgcatagcaaagcgataacgataaatatcccaaaaggagtattcggattttgcacggcaattccgagccagacgcaaggaataatcaggattgcagtactaaaaaccgtccatcggcgtccaccgaatataggcaccataaaggagtagggaacacgcaataatgcgccagaaacggagggtaatgcggttaataaaaagagttgatcggtagtaaaattaaaaccgattttattgagattaacggtaactgcgctaaatagcatccagacacagaaggcaagaagtagacaactgactgatatccagagatttcttcgagcaatatgttttcctttattttcccagaaggccggattttctggtttccagtcgcgcaaaagataacgactatttttctcattttgcagtgccatattgttcctcacatgcacacattggtaatgaaaaaaagacaaaacacgaggtaaggcgcaatagccagttattagaattaaggatgaattgggtgaagtgctgattgaaagaatagataagaaagcgtaaccgcgggggcagaatggggattaagtagccagatatgtgttactaaatgtaactaacaagctaaccttcaaacggggttaatctttgaacgtatgtcatgtttcaacccttcagatcgtgaatctaaagggttacatattaactatattatcaacaagaccagacacttatagaattagtgatgatttattcactaaaaaggccatgaactggaggaaaacgatctgtccagaaggtctatcggttcctctcttattgcctgattgtaataatcgttattacagtaagtattgtttatttcatctaaggtcatgtttttaacttttatattcatctggtttacaacttcctctgtcttgtaagtgtgtatattatatggggtatatgcttttttaataggatagtgaaacaattcgttatccacatctattccgtcagagtgaacttcaaatgcaccaggcgaaagaattgccaggccagtattaagcttaagtgctggggaaaacaaattaaataacatgagctgcatagtagggcaattgttcttcccagaaacatttaaaaaatttaagttttgctctgttttattatggggaataaagttccaatatcggatgtattattagtatcaatgtgggttattttattattgtccagtcttaaacttttgatagatggaagataagtcaggaaatcaagatttatatatttcaactggttgttagcagcgtttaatgtctgaacattgcagaagttgctatagaatattttaatttcagaaagcaaattgttgttaataagtaacgtattcaagttgggaaataagtcattgtgtaaacttgttagtttattatgggatagatccagcagtaagagttcatttttattacctgcaacaatatcagttaattgattatggctgagattcaggtattgcagccattcgcaagattctaattgcacaaactctagttgattatgtgccgcactaaaataagtaactgatgaaagcctatctatatcaatatttctgagagcattattattcatagatatatgtgtaatacttacatttctgccttgaggaaaatttattgactcaagagcattactattcagacttagctttacgagtctatcgtagttggttgcatcaaaatgtgtgaattggttattatcaagattgatagatgtgaagttttgcagccctggtggttgagtggttaaattaagtcctgataaatcaatggtcacttcattagtgtcatcaattatatttcttactgcagtccagtactgcatttgtgcaagtggatcattgttgatgccgttaactaatacatgccaaagatgttttgatgatattagttgatcaatgtcattggttggcagtaaattgttattgcttaagtttaaatattccagttttgtagtgtttttggcgtttaaatgtgcaatatggttgtcgtttaaagtgattgttttcatcctgggatgattgtgtaatataaggtcagtgatcatattgtgatgggcacttaactcaatcagagattcttgccgcgcgagccgttggcttcatcgttatagcctttaaaatcatattcccagtgaccaaaaccaatcatttgatcattgatttgcgtttctcctttaaagccgagacgggcataagttttatcaccatcgtcacgcttatcatcagtaaaataacgtagagcggtaaccttgccataaaggtcgagtttattaccatccttgttatagacttcggcagcgtgtgctacgttcgcagctaacaaaccagttacaaccaccgcaactatttttaatttcatttaacagaatccttttaattatcgttaaacgtattttctaaacgaattttaaacggcgtcatttataaatgacatactgtttttaaaatagaatggtgattaaaaacaatgagaaaaatagatgaaataatattatttatcgatatgtgatcgaagtcgaaatgagatataaggtgaattactggtatttgaaatttatttttttaatattgtcggaatttatctgattaactaccgggccgtagacccggcagttattttaaccacgacgtgtcgccagccagcagagcagggaaccgccgcagaccatcagcgcgccttgccagaacgagaacgacagcggggcgctgagcagcacggctgcaagcgctgaggaaagtacaggcgtaaaatacgaacctaccgccataatggtgacattgccatgcaatataccgacattccatgcagcataagcaaatcctaaggtaaatgccgcagagatgagtttaatcatgacgggcgtgctaaatatcatttctggttgtggcgtaagaaaatagtaaacccacagacttgctcccgttagcaggacaaaaacggtaattccattaaatccgcgtgcgtatttattcgttactgtgcaataggctgcccagataaacgcaccaatgaacgccaggaaataactcaatgggctggtggtgatattattgatgatttcatcataatgtaacccattgtcaccgcctaacacccaacagacgccgacgagggctaataataatccaggtacaatcaaccagttggttttctgaccattaaacagaatggcaaagagaattgtcaggctgggccacagatagttcaccatacccacttcaatcgcctgatgatgggtcgccgcataccctaaggaaagcgccagacagatttcatagctgacgaataacagactcccggcgagtaaatagcctttcgggatttgccgaatacgcggaaatccaaccgtgaagattaacagcagcccgcttaatgaatagatagcagctgcgccgccgaccgggccgagcccctcactgacaccgcgaatcaatcctaccatcgtgctccacaggacgatcgctatcagccctatgagcgttgctttttgtcgtgtcatgctcgctgttttgtctctcttgccgttaaaaattaagctgaattttatagcatttttttaactggcctgtcaggcagtggtgcgtttttctaccgctattgaggtaggtcaatttgcgaaggcggattattttgtggcaaacagatgttctttttgatttcgcgcaaaaagattcagaattttactgttagtttcctcgcgcagtaatacccctgaaaaaagaggaaagcaatggacgtcagtcgcagacaattttttaaaatctgcgcgggcggtatggctggaacaacagtagcggcattgggctttgccccgaagcaagcactggctcaggcgcgaaactacaaattattacgcgctaaagagatccgtaacacctgcacatactgttccgtaggttgcgggctattgatgtatagcctgggtgatggcgcaaaaaacgccagagaagcgatttatcacattgaaggtgacccggatcatccggtaagccgtggtgcgctgtgcccgaaaggggccggtttgctggattacgtcaacagtgaaaaccgtctgcgctacccggaatatcgtgcgccaggttctgacaaatggcagcgcattagctgggaagaagcattctcccgtattgcgaagctgatgaaagctgaccgtgacgctaactttattgaaaagaacgagcagggcgtaacggtaaaccgttggctttctaccggtatgctgtgtgcctccggtgccagcaacgaaaccgggatgctgacccagaaatttgcccgctccctcgggatgctggcggtagacaaccaggcgcgcgtctgacacggaccaacggtagcaagtcttgctccaacatttggtcgcggtgcgatgaccaaccactgggtggatatcaaaaacgctaacgtcgtgatggtgatgggcggtaacgctgctgaagcgcatcccgtcggtttccgctgggcgatggaagcgaaaaacaacaacgacgcaaccttgatcgttgtcgatccccgttttacgcgtaccgcttctgtggcggatatttacgcgcctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataaatcgtcctggaactatcagctcgatgaaaacggctatgcgaaacgcgatgaaacactgactcatccgcgctgtgtgtggaacctgctgaaagagcacgtttcccgctacacgccggacgtcgttgaaaaca

(The sequence listing continues in the following parts.)

What is claimed is:

1. A genetically engineered recombinant *E. coli* comprising a genetic modification of pflABfocA and a genetic modification of pflDC which genetic modifications substantially reduce pyruvate formate lyase (PFL) activity, and a genetic modification which substantially reduces pyruvate dehydrogenase (PDH) activity, wherein the genetically engineered recombinant *E. coli* comprises a genotype of: pflABfocA pflDC aceEF xylFGH rbsACB alsBAC mutS.

2. The genetically engineered recombinant *E. coli* of claim 1, wherein the genetically engineered recombinant *E. coli* is configured for producing carbohydrates, wherein producing carbohydrates comprises producing D-lactate from a glucose precursor.

3. The genetically engineered recombinant *E. coli* of claim 1, wherein the genetic modifications which substantially reduce PFL activity reduce PFL activity by at least about 70%.

4. The genetically engineered recombinant *E. coli* of claim 1, wherein the genetic modification which substantially reduces PDH activity reduces PDH activity by at least about 70%.

5. The genetically engineered recombinant *E. coli* of claim 1, wherein the genetic modification which substantially reduces PFL activity reduces PFL activity by at least about 90%, and wherein the genetic modification which substantially reduces PDH activity reduces PDH activity by at least about 90%.

6. The genetically engineered recombinant *E. coli* of claim 1, wherein the genetic modifications which substantially reduce PFL activity eliminate PFL activity, and wherein the genetic modification which substantially reduces PDH activity eliminates PDH activity.

7. The genetically engineered recombinant *E. coli* of claim 1, wherein the genetically engineered recombinant *E. coli* has undergone adaptive evolution.

8. The genetically engineered recombinant *E. coli* of claim 1, further comprising a genetic modification that increases the mutation rate of the genetically engineered recombinant *E. coli* at least about 2-fold per generation.

9. The genetically engineered recombinant *E. coli* of claim 8, wherein the genetic modification that increases the mutation rate comprises a loss-of-function mutation in the mutS gene.

10. The genetically engineered recombinant *E. coli* of claim 1, wherein the genetic modifications which substantially reduce PFL activity are selected from the group consisting of: a hypomorphic mutation in each of pflABfocA and pflDC, a phenotypic null mutation in each of pflABfocA and pflDC, a deletion of each of pflABfocA and pflDC, a hypomorphic mutation in pflABfocA and a deletion of pflDC, a deletion of pflABfocA and a hypomorphic mutation in pflDC, a hypomorphic mutation in pflABfocA and a phenotypic null mutation in pflDC, a null mutation in pflABfocA and a hypomorphic mutation in pflDC, a deletion of in pflABfocA and a null mutation in pflDC, and a phenotypic null mutation in pflABfocA and a deletion of pflDC.

11. The genetically engineered recombinant *E. coli* of claim 1, wherein the genetic modification which substantially reduces PDH activity is selected from the group consisting of a hypomorphic mutation in aceEF, a null mutation in aceEF, and a deletion of aceEF.

12. The genetically engineered recombinant *E. coli* of claim 1, wherein the genetic modifications which substantially reduce PFL activity comprise a deletion of each of pflABfocA and pflDC, and wherein the genetic modification eliminating PDH activity comprises a deletion of aceEF.

13. The genetically engineered recombinant *E. coli* of claim 1, wherein the genetically engineered recombinant *E. coli* is of one of the BOP384eG1 strain or BOP384eG2 strain.

14. The genetically engineered recombinant *E. coli* of claim 1, further comprising deletion of each of a native xylGFH, rbsACB, and alsBAC operon.

15. The genetically engineered recombinant *E. coli* of claim 1, further comprising at least one mutation selected from the group consisting of: 1022011 C→T, 111897 G→A, 1135244 A→G, 1137595 A→G, 1163111 A→G, 1247873 G→A, 1260197 C→T, 1274794 T→C, 1386732 A→G, 1435247 Δ1 bp, 1440978 G→A, 1580390 A→G, 1604028 T→C, 1610530+C, 1679479 T→C, 1682336 A→G, 1729483 G→A, 1760136 G→A, 1866695 G→A, 1929016 G→A, 1950262 G→A, 1976527 Δ776 bp, 2071288 G→A, 2085304+G, 2098010 T→C, 2257220 A→G, 2358479+C, 2405257 G→C, 2534334 Δ1::IS186 (−)+6 bp::Δ1, 2620968 Δ1 bp, 2662540 T→C, 2732557+C, 2740321 T→C, 2763809+C, 2767188 G→A, 2782127 A→G, 2809146+A, 2824039 T→C, 2826646 G→A, 2844070 G→A, 2926442+T, 2927497 G→A, 2932138 T→A, 2965591 T→C, 2975919 T→C, 3114125 C→T, 3176882 G→A, 3218853 T→C, 3246033 G→A, 3268091 C→T, 3268123 C→A, 3268165 C→T, 3279141 C→T, 3302829 Δ1 bp, 3315496 A→G, 3335733 C→T, 34111+T, 3429378 T→C, 345189 A→G, 3506796 T→C, 3526004 T→C, 3548297 T→C, 379237 Δ1 bp, 379237 Δ2 bp, 386281 C→T, 3955730 G→A, 3957957 C→T, 3978813 C→A, 3982057 C→T, 3983344 C→T, 3990407 Δ8 bp, 407943 A→G, 4105271 A→G, 4153541 A→G, 42111 C→A, 4234068 T→G, 4294403+CG, 4306572 3434 bp→82 bp, 4444833 A→G, 4503718 G→A, 454725 C→T, 4604230+G, 4604346 Δ1 bp, 507894 T→C, 533362 A→G, 547694 A→G, 547831+G, 558493 G→T, 560913+G, 619171 A→G, 653396 T→C, 696062 G→A, 700027 C→T, 700286+C, 700599+C, 700679+G, 751964 C→T, 760544 C→T, 844446 C→T, 852434+A, 922473+G, 961467 C→T, and 963462 A→G, with reference to SEQ ID NO: 1.

16. The genetically engineered recombinant *E. coli* of claim 2, wherein the genetically engineered recombinant *E. coli* has a steady-state glucose uptake rate of at least about 30 mmol per gDW per hour under standard conditions in 1 g per liter yeast extract medium.

17. A genetically engineered, recombinant *E. coli* comprising a genetic modification of pflABfocA and a genetic modification of pflDC which genetic modifications reduce pyruvate formate lyase (PFL) activity, and a genetic modification which reduces pyruvate deghydrogenase (PDH) activity, wherein said genetically engineered recombinant *E. coli* has a steady-state glucose uptake rate of at least about 30 mmol per gDW per hour under standard conditions in 1 g per liter yeast extract medium, the genetically engineered recombinant *E. coli* further comprising at least one mutation selected from the group consisting of: 1022011 C→T, 111897 G→A, 1135244 A→*G, 1137595 A→G, 1163111 A→G, 1247873 G→A, 1260197 C→T, 1274794 T→C, 1386732 A→G, 1435247 Δ1 bp, 1440978 G→A, 1580390 A→G, 1604028 T→C, 1610530+C, 1682336 A→G, 1729483 G→A, 1760136 G→A, 1866695 G→A, 1929016 G→A, 1950262 G→A, 2071288 G→A, 2085304+G, 2098010 T→C, 2257220 A→G, 2358479+C, 2620968 Δ1 bp, 2662540 T→C, 2732557+C, 2763809+C, 2767188 G→A, 2782127 A→G, 2809146+A, 2824039 T→C, 2826646 G→A, 2844070 G→A, 2926442+T, 2927497 G→A, 2965591 T→C, 2975919 T→C, 3114125 C→T, 3176882 G→A, 3218853 T→C, 3246033 G→A, 3268091 C→T, 3268123 C→A, 3268165 C→T, 3302829 Δ1 bp, 3335733 C→T, 34111+T, 3429378 T→C, 345189 A→G, 3506796 T→C, 3526004 T→C, 3548297 T→C, 379237 Δ1 bp, 379237 Δ2 bp, 386281 C→T, 3978813 C→A, 3982057 C→T, 3983344 C→T, 407943 A→G, 4105271 A→G, 42111 C→A, 4234068 T→G, 4444833 A→G, 4503718 G→A, 454725 C→T, 4604230+G, 4604346 Δ1 bp, 533362 A→G, 558493 G→T, 560913+G, 619171 A→G, 653396 T→C, 696062 G→A, 700027 C→T, 700286+C, 700599+C, 700679+G, 760544 C→T, 844446 C→T, 852434+A, 922473+G, 961467 C→T and 963462 A→G, with reference to SEQ ID NO: 1.

18. A genetically engineered recombinant *E. coli* comprising a genetic modification of pflABfocA and a genetic modification of pflDC which genetic modifications substantially reduce pyruvate formate lyase (PFL) activity, and a genetic modification which substantially reduces pyruvate dehydrogenase (PDH) activity, the genetically engineered recombinant *E. coli* comprising deletion of each of a native xylGFH, rbsACB, and alsBAC operon.

* * * * *